United States Patent 8,598,333 (SIRNA SILENCING OF GENES EXPRESSED IN CANCER) - sequence listing, part 2

SEQ ID NO: 15111 - DNA, 23 bp, Artificial Sequence
  X-linked inhibitor of apoptosis (XIAP) siRNA
aatggagactaccgccccagcat

SEQ ID NO: 15112 - DNA, 23 bp, Artificial Sequence
  X-linked inhibitor of apoptosis (XIAP) siRNA
atggagactaccgccccagcatt

SEQ ID NO: 15113 - DNA, 23 bp, Artificial Sequence
  X-linked inhibitor of apoptosis (XIAP) siRNA
tggagactaccgccccagcatta

SEQ ID NO: 15114 - DNA, 23 bp, Artificial Sequence
  X-linked inhibitor of apoptosis (XIAP) siRNA
ggagactaccgccccagcattag

SEQ ID NO: 15115 - DNA, 23 bp, Artificial Sequence
  X-linked inhibitor of apoptosis (XIAP) siRNA
gagactaccgccccagcattagt

SEQ ID NO: 15116 - DNA, 23 bp, Artificial Sequence
  X-linked inhibitor of apoptosis (XIAP) siRNA
agactaccgccccagcattagtt

SEQ ID NO: 15117 - DNA, 23 bp, Artificial Sequence
  X-linked inhibitor of apoptosis (XIAP) siRNA
gactaccgccccagcattagttt

SEQ ID NO: 15118 - DNA, 23 bp, Artificial Sequence
  X-linked inhibitor of apoptosis (XIAP) siRNA
actaccgccccagcattagtttc

SEQ ID NO: 15119 - DNA, 23 bp, Artificial Sequence
  X-linked inhibitor of apoptosis (XIAP) siRNA
ctaccgccccagcattagtttca

SEQ ID NO: 15120 - DNA, 23 bp, Artificial Sequence
  X-linked inhibitor of apoptosis (XIAP) siRNA
taccgccccagcattagtttcac

SEQ ID NO: 15121 - DNA, 23 bp, Artificial Sequence
  X-linked inhibitor of apoptosis (XIAP) siRNA
accgccccagcattagtttcaca

SEQ ID NO: 15122 - DNA, 23 bp, Artificial Sequence
  X-linked inhibitor of apoptosis (XIAP) siRNA
ccgccccagcattagtttcacat

SEQ ID NO: 15123 - DNA, 23 bp, Artificial Sequence
  X-linked inhibitor of apoptosis (XIAP) siRNA
cgccccagcattagtttcacatg

SEQ ID NO: 15124 - DNA, 23 bp, Artificial Sequence
  X-linked inhibitor of apoptosis (XIAP) siRNA
gccccagcattagtttcacatga

SEQ ID NO: 15125 - DNA, 23 bp, Artificial Sequence
  X-linked inhibitor of apoptosis (XIAP) siRNA
ccccagcattagtttcacatgat

SEQ ID NO: 15126 - DNA, 23 bp, Artificial Sequence
  X-linked inhibitor of apoptosis (XIAP) siRNA
cccagcattagtttcacatgata

SEQ ID NO: 15127 - DNA, 23 bp, Artificial Sequence
  X-linked inhibitor of apoptosis (XIAP) siRNA
ccagcattagtttcacatgatat

SEQ ID NO: 15128 - DNA, 23 bp, Artificial Sequence
  X-linked inhibitor of apoptosis (XIAP) siRNA
cagcattagtttcacatgatata

SEQ ID NO: 15129 - DNA, 23 bp, Artificial Sequence
  X-linked inhibitor of apoptosis (XIAP) siRNA
agcattagtttcacatgatatac

SEQ ID NO: 15130 - DNA, 23 bp, Artificial Sequence
  X-linked inhibitor of apoptosis (XIAP) siRNA
gcattagtttcacatgatatacc

SEQ ID NO: 15131 - DNA, 23 bp, Artificial Sequence
  X-linked inhibitor of apoptosis (XIAP) siRNA
cattagtttcacatgatataccc

SEQ ID NO: 15132 - DNA, 23 bp, Artificial Sequence
  X-linked inhibitor of apoptosis (XIAP) siRNA
attagtttcacatgatataccct

SEQ ID NO: 15133 - DNA, 23 bp, Artificial Sequence
  X-linked inhibitor of apoptosis (XIAP) siRNA
ttagtttcacatgatataccctt

SEQ ID NO: 15134 - DNA, 23 bp, Artificial Sequence
  X-linked inhibitor of apoptosis (XIAP) siRNA
tagtttcacatgatatacccttt

SEQ ID NO: 15135 - DNA, 23 bp, Artificial Sequence
  X-linked inhibitor of apoptosis (XIAP) siRNA
agtttcacatgatatacccttta

SEQ ID NO: 15136 - DNA, 23 bp, Artificial Sequence
  X-linked inhibitor of apoptosis (XIAP) siRNA
gtttcacatgatataccctttaa

SEQ ID NO: 15137 - DNA, 23 bp, Artificial Sequence
  X-linked inhibitor of apoptosis (XIAP) siRNA
tttcacatgatataccctttaaa

SEQ ID NO: 15138 - DNA, 23 bp, Artificial Sequence
  X-linked inhibitor of apoptosis (XIAP) siRNA
ttcacatgatataccctttaaac

SEQ ID NO: 15139 - DNA, 23 bp, Artificial Sequence
  X-linked inhibitor of apoptosis (XIAP) siRNA
tcacatgatataccctttaaacc

SEQ ID NO: 15140 - DNA, 23 bp, Artificial Sequence
  X-linked inhibitor of apoptosis (XIAP) siRNA
cacatgatataccctttaaaccc

SEQ ID NO: 15141 - DNA, 23 bp, Artificial Sequence
  X-linked inhibitor of apoptosis (XIAP) siRNA
acatgatataccctttaaacccg

SEQ ID NO: 15142 - DNA, 23 bp, Artificial Sequence
  X-linked inhibitor of apoptosis (XIAP) siRNA
catgatataccctttaaacccga

SEQ ID NO: 15143 - DNA, 23 bp, Artificial Sequence
  X-linked inhibitor of apoptosis (XIAP) siRNA
atgatataccctttaaacccgaa

SEQ ID NO: 15144 - DNA, 23 bp, Artificial Sequence
  X-linked inhibitor of apoptosis (XIAP) siRNA
tgatataccctttaaacccgaat

SEQ ID NO: 15145 - DNA, 23 bp, Artificial Sequence
  X-linked inhibitor of apoptosis (XIAP) siRNA
gatataccctttaaacccgaatc

SEQ ID NO: 15146 - DNA, 23 bp, Artificial Sequence
  X-linked inhibitor of apoptosis (XIAP) siRNA
atataccctttaaacccgaatca

SEQ ID NO: 15147 - DNA, 23 bp, Artificial Sequence
  X-linked inhibitor of apoptosis (XIAP) siRNA
tataccctttaaacccgaatcat

SEQ ID NO: 15148 - DNA, 23 bp, Artificial Sequence
  X-linked inhibitor of apoptosis (XIAP) siRNA
ataccctttaaacccgaatcatt

SEQ ID NO: 15149 - DNA, 23 bp, Artificial Sequence
  X-linked inhibitor of apoptosis (XIAP) siRNA
taccctttaaacccgaatcattg

SEQ ID NO: 15150 - DNA, 23 bp, Artificial Sequence
  X-linked inhibitor of apoptosis (XIAP) siRNA
accctttaaacccgaatcattgt

SEQ ID NO: 15151 - DNA, 23 bp, Artificial Sequence
  X-linked inhibitor of apoptosis (XIAP) siRNA
ccctttaaacccgaatcattgtt

SEQ ID NO: 15152 - DNA, 23 bp, Artificial Sequence
  X-linked inhibitor of apoptosis (XIAP) siRNA
cctttaaacccgaatcattgttt

SEQ ID NO: 15153 - DNA, 23 bp, Artificial Sequence
  X-linked inhibitor of apoptosis (XIAP) siRNA
ctttaaacccgaatcattgtttt

SEQ ID NO: 15154 - DNA, 23 bp, Artificial Sequence
  X-linked inhibitor of apoptosis (XIAP) siRNA
tttaaacccgaatcattgtttta

SEQ ID NO: 15155 - DNA, 23 bp, Artificial Sequence
  X-linked inhibitor of apoptosis (XIAP) siRNA
ttaaacccgaatcattgttttat

SEQ ID NO: 15156 - DNA, 23 bp, Artificial Sequence
  X-linked inhibitor of apoptosis (XIAP) siRNA
taaacccgaatcattgttttatt

SEQ ID NO: 15157 - DNA, 23 bp, Artificial Sequence
  X-linked inhibitor of apoptosis (XIAP) siRNA
aaacccgaatcattgttttattt

SEQ ID NO: 15158 - DNA, 23 bp, Artificial Sequence
  X-linked inhibitor of apoptosis (XIAP) siRNA
aacccgaatcattgttttatttc

SEQ ID NO: 15159 - DNA, 23 bp, Artificial Sequence
  X-linked inhibitor of apoptosis (XIAP) siRNA
acccgaatcattgttttatttcc

SEQ ID NO: 15160 - DNA, 23 bp, Artificial Sequence
  X-linked inhibitor of apoptosis (XIAP) siRNA
cccgaatcattgttttatttcct

SEQ ID NO: 15161 - DNA, 23 bp, Artificial Sequence
  X-linked inhibitor of apoptosis (XIAP) siRNA
ccgaatcattgttttatttcctg

SEQ ID NO: 15162 - DNA, 23 bp, Artificial Sequence
  X-linked inhibitor of apoptosis (XIAP) siRNA
cgaatcattgttttatttcctga

SEQ ID NO: 15163 - DNA, 23 bp, Artificial Sequence
  X-linked inhibitor of apoptosis (XIAP) siRNA
gaatcattgttttatttcctgat

SEQ ID NO: 15164 - DNA, 23 bp, Artificial Sequence
  X-linked inhibitor of apoptosis (XIAP) siRNA
aatcattgttttatttcctgatt

SEQ ID NO: 15165 - DNA, 23 bp, Artificial Sequence
  X-linked inhibitor of apoptosis (XIAP) siRNA
atcattgttttatttcctgatta

SEQ ID NO: 15166 - DNA, 23 bp, Artificial Sequence
  X-linked inhibitor of apoptosis (XIAP) siRNA
tcattgttttatttcctgattac

SEQ ID NO: 15167 - DNA, 23 bp, Artificial Sequence
  X-linked inhibitor of apoptosis (XIAP) siRNA
cattgttttatttcctgattaca

SEQ ID NO: 15168 - DNA, 23 bp, Artificial Sequence
  X-linked inhibitor of apoptosis (XIAP) siRNA
attgttttatttcctgattacac

SEQ ID NO: 15169 - DNA, 23 bp, Artificial Sequence
  X-linked inhibitor of apoptosis (XIAP) siRNA
ttgttttatttcctgattacaca

SEQ ID NO: 15170 - DNA, 23 bp, Artificial Sequence
  X-linked inhibitor of apoptosis (XIAP) siRNA
tgttttatttcctgattacacag

SEQ ID NO: 15171 - DNA, 23 bp, Artificial Sequence
  X-linked inhibitor of apoptosis (XIAP) siRNA
gttttatttcctgattacacagg

SEQ ID NO: 15172 - DNA, 23 bp, Artificial Sequence
  X-linked inhibitor of apoptosis (XIAP) siRNA
ttttatttcctgattacacaggt

SEQ ID NO: 15173 - DNA, 23 bp, Artificial Sequence
  X-linked inhibitor of apoptosis (XIAP) siRNA
tttatttcctgattacacaggtg

SEQ ID NO: 15174 - DNA, 23 bp, Artificial Sequence
  X-linked inhibitor of apoptosis (XIAP) siRNA
ttatttcctgattacacaggtgt

SEQ ID NO: 15175 - DNA, 23 bp, Artificial Sequence
  X-linked inhibitor of apoptosis (XIAP) siRNA
tatttcctgattacacaggtgtt

SEQ ID NO: 15176 - DNA, 23 bp, Artificial Sequence
  X-linked inhibitor of apoptosis (XIAP) siRNA
atttcctgattacacaggtgttg

SEQ ID NO: 15177 - DNA, 23 bp, Artificial Sequence
  X-linked inhibitor of apoptosis (XIAP) siRNA
tttcctgattacacaggtgttga

SEQ ID NO: 15178 - DNA, 23 bp, Artificial Sequence
  X-linked inhibitor of apoptosis (XIAP) siRNA
ttcctgattacacaggtgttgaa

SEQ ID NO: 15179 - DNA, 23 bp, Artificial Sequence
  X-linked inhibitor of apoptosis (XIAP) siRNA
tcctgattacacaggtgttgaat

SEQ ID NO: 15180 - DNA, 23 bp, Artificial Sequence
  X-linked inhibitor of apoptosis (XIAP) siRNA
cctgattacacaggtgttgaatg

SEQ ID NO: 15181 - DNA, 23 bp, Artificial Sequence
  X-linked inhibitor of apoptosis (XIAP) siRNA
ctgattacacaggtgttgaatgg

SEQ ID NO: 15182 - DNA, 23 bp, Artificial Sequence
  X-linked inhibitor of apoptosis (XIAP) siRNA
tgattacacaggtgttgaatggg

SEQ ID NO: 15183 - DNA, 23 bp, Artificial Sequence
  X-linked inhibitor of apoptosis (XIAP) siRNA
gattacacaggtgttgaatgggg

SEQ ID NO: 15184 - DNA, 23 bp, Artificial Sequence
  X-linked inhibitor of apoptosis (XIAP) siRNA
attacacaggtgttgaatgggga

SEQ ID NO: 15185 - DNA, 23 bp, Artificial Sequence
  X-linked inhibitor of apoptosis (XIAP) siRNA
ttacacaggtgttgaatggggaa

SEQ ID NO: 15186 - DNA, 23 bp, Artificial Sequence
  X-linked inhibitor of apoptosis (XIAP) siRNA
tacacaggtgttgaatggggaaa

SEQ ID NO: 15187 - DNA, 23 bp, Artificial Sequence
  X-linked inhibitor of apoptosis (XIAP) siRNA
acacaggtgttgaatggggaaag

SEQ ID NO: 15188 - DNA, 23 bp, Artificial Sequence
  X-linked inhibitor of apoptosis (XIAP) siRNA
cacaggtgttgaatggggaaagg

SEQ ID NO: 15189 - DNA, 23 bp, Artificial Sequence
  X-linked inhibitor of apoptosis (XIAP) siRNA
acaggtgttgaatggggaaaggg

SEQ ID NO: 15190 - DNA, 23 bp, Artificial Sequence
  X-linked inhibitor of apoptosis (XIAP) siRNA
caggtgttgaatggggaaagggg

SEQ ID NO: 15191 - DNA, 23 bp, Artificial Sequence
  X-linked inhibitor of apoptosis (XIAP) siRNA
aggtgttgaatggggaaaggggc

SEQ ID NO: 15192 - DNA, 23 bp, Artificial Sequence
  X-linked inhibitor of apoptosis (XIAP) siRNA
ggtgttgaatggggaaaggggct

SEQ ID NO: 15193 - DNA, 23 bp, Artificial Sequence
  X-linked inhibitor of apoptosis (XIAP) siRNA
gtgttgaatggggaaaggggcta

SEQ ID NO: 15194 - DNA, 23 bp, Artificial Sequence
  X-linked inhibitor of apoptosis (XIAP) siRNA
tgttgaatggggaaaggggctag

SEQ ID NO: 15195 - DNA, 23 bp, Artificial Sequence
  X-linked inhibitor of apoptosis (XIAP) siRNA
gttgaatggggaaaggggctagt

SEQ ID NO: 15196 - DNA, 23 bp, Artificial Sequence
  X-linked inhibitor of apoptosis (XIAP) siRNA
ttgaatggggaaaggggctagta

SEQ ID NO: 15197 - DNA, 23 bp, Artificial Sequence
  X-linked inhibitor of apoptosis (XIAP) siRNA
tgaatggggaaaggggctagtat

SEQ ID NO: 15198 - DNA, 23 bp, Artificial Sequence
  X-linked inhibitor of apoptosis (XIAP) siRNA
gaatggggaaaggggctagtata

SEQ ID NO: 15199 - DNA, 23 bp, Artificial Sequence
  X-linked inhibitor of apoptosis (XIAP) siRNA
aatggggaaaggggctagtatat

SEQ ID NO: 15200 - DNA, 23 bp, Artificial Sequence
  X-linked inhibitor of apoptosis (XIAP) siRNA
atggggaaaggggctagtatatc

SEQ ID NO: 15201 - DNA, 23 bp, Artificial Sequence
  X-linked inhibitor of apoptosis (XIAP) siRNA
tggggaaaggggctagtatatca

SEQ ID NO: 15202 - DNA, 23 bp, Artificial Sequence
  X-linked inhibitor of apoptosis (XIAP) siRNA
ggggaaaggggctagtatatcag

SEQ ID NO: 15203 - DNA, 23 bp, Artificial Sequence
  X-linked inhibitor of apoptosis (XIAP) siRNA
gggaaaggggctagtatatcagt

SEQ ID NO: 15204 - DNA, 23 bp, Artificial Sequence
  X-linked inhibitor of apoptosis (XIAP) siRNA
ggaaaggggctagtatatcagta

SEQ ID NO: 15205 - DNA, 23 bp, Artificial Sequence
  X-linked inhibitor of apoptosis (XIAP) siRNA
gaaaggggctagtatatcagtag

SEQ ID NO: 15206 - DNA, 23 bp, Artificial Sequence
  X-linked inhibitor of apoptosis (XIAP) siRNA
aaaggggctagtatatcagtagg

SEQ ID NO: 15207 - DNA, 23 bp, Artificial Sequence
  X-linked inhibitor of apoptosis (XIAP) siRNA
aaggggctagtatatcagtagga

SEQ ID NO: 15208 - DNA, 23 bp, Artificial Sequence
  X-linked inhibitor of apoptosis (XIAP) siRNA
aggggctagtatatcagtaggat

SEQ ID NO: 15209 - DNA, 23 bp, Artificial Sequence
  X-linked inhibitor of apoptosis (XIAP) siRNA
ggggctagtatatcagtaggata

SEQ ID NO: 15210 - DNA, 23 bp, Artificial Sequence
  X-linked inhibitor of apoptosis (XIAP) siRNA
gggctagtatatcagtaggatat

SEQ ID NO: 15211 - DNA, 23 bp, Artificial Sequence
  X-linked inhibitor of apoptosis (XIAP) siRNA
ggctagtatatcagtaggatata

SEQ ID NO: 15212 - DNA, 23 bp, Artificial Sequence
  X-linked inhibitor of apoptosis (XIAP) siRNA
gctagtatatcagtaggatatac

SEQ ID NO: 15213 - DNA, 23 bp, Artificial Sequence
  X-linked inhibitor of apoptosis (XIAP) siRNA
ctagtatatcagtaggatatact

SEQ ID NO: 15214 - DNA, 23 bp, Artificial Sequence
  X-linked inhibitor of apoptosis (XIAP) siRNA
tagtatatcagtaggatatacta

SEQ ID NO: 15215 - DNA, 23 bp, Artificial Sequence
  X-linked inhibitor of apoptosis (XIAP) siRNA
agtatatcagtaggatatactat

SEQ ID NO: 15216 - DNA, 23 bp, Artificial Sequence
  X-linked inhibitor of apoptosis (XIAP) siRNA
gtatatcagtaggatatactatg

SEQ ID NO: 15217 - DNA, 23 bp, Artificial Sequence
  X-linked inhibitor of apoptosis (XIAP) siRNA
tatatcagtaggatatactatgg

SEQ ID NO: 15218 - DNA, 23 bp, Artificial Sequence
  X-linked inhibitor of apoptosis (XIAP) siRNA
atatcagtaggatatactatggg

SEQ ID NO: 15219 - DNA, 23 bp, Artificial Sequence
  X-linked inhibitor of apoptosis (XIAP) siRNA
tatcagtaggatatactatggga

SEQ ID NO: 15220 - DNA, 23 bp, Artificial Sequence
  X-linked inhibitor of apoptosis (XIAP) siRNA
atcagtaggatatactatgggat

SEQ ID NO: 15221 - DNA, 23 bp, Artificial Sequence
  X-linked inhibitor of apoptosis (XIAP) siRNA
tcagtaggatatactatgggatg

SEQ ID NO: 15222 - DNA, 23 bp, Artificial Sequence
  X-linked inhibitor of apoptosis (XIAP) siRNA
cagtaggatatactatgggatgt

SEQ ID NO: 15223 - DNA, 23 bp, Artificial Sequence
  X-linked inhibitor of apoptosis (XIAP) siRNA
agtaggatatactatgggatgta

SEQ ID NO: 15224 - DNA, 23 bp, Artificial Sequence
  X-linked inhibitor of apoptosis (XIAP) siRNA
gtaggatatactatgggatgtat

SEQ ID NO: 15225 - DNA, 23 bp, Artificial Sequence
  X-linked inhibitor of apoptosis (XIAP) siRNA
taggatatactatgggatgtata

SEQ ID NO: 15226 - DNA, 23 bp, Artificial Sequence
  X-linked inhibitor of apoptosis (XIAP) siRNA
aggatatactatgggatgtatat

SEQ ID NO: 15227 - DNA, 23 bp, Artificial Sequence
  X-linked inhibitor of apoptosis (XIAP) siRNA
ggatatactatgggatgtatata

SEQ ID NO: 15228 - DNA, 23 bp, Artificial Sequence
  X-linked inhibitor of apoptosis (XIAP) siRNA
gatatactatgggatgtatatat

SEQ ID NO: 15229 - DNA, 23 bp, Artificial Sequence
  X-linked inhibitor of apoptosis (XIAP) siRNA
atatactatgggatgtatatata

SEQ ID NO: 15230 - DNA, 23 bp, Artificial Sequence
  X-linked inhibitor of apoptosis (XIAP) siRNA
tatactatgggatgtatatatat

SEQ ID NO: 15231 - DNA, 23 bp, Artificial Sequence
  X-linked inhibitor of apoptosis (XIAP) siRNA
atactatgggatgtatatatatc

SEQ ID NO: 15232 - DNA, 23 bp, Artificial Sequence
  X-linked inhibitor of apoptosis (XIAP) siRNA
tactatgggatgtatatatatca

SEQ ID NO: 15233 - DNA, 23 bp, Artificial Sequence
  X-linked inhibitor of apoptosis (XIAP) siRNA
actatgggatgtatatatatcat

SEQ ID NO: 15234 - DNA, 23 bp, Artificial Sequence
  X-linked inhibitor of apoptosis (XIAP) siRNA
ctatgggatgtatatatatcatt

SEQ ID NO: 15235 - DNA, 23 bp, Artificial Sequence
  X-linked inhibitor of apoptosis (XIAP) siRNA
tatgggatgtatatatatcattg

SEQ ID NO: 15236 - DNA, 23 bp, Artificial Sequence
  X-linked inhibitor of apoptosis (XIAP) siRNA
atgggatgtatatatatcattgc

SEQ ID NO: 15237 - DNA, 23 bp, Artificial Sequence
  X-linked inhibitor of apoptosis (XIAP) siRNA
tgggatgtatatatatcattgct

SEQ ID NO: 15238 - DNA, 23 bp, Artificial Sequence
  X-linked inhibitor of apoptosis (XIAP) siRNA
gggatgtatatatatcattgctg

SEQ ID NO: 15239 - DNA, 23 bp, Artificial Sequence
  X-linked inhibitor of apoptosis (XIAP) siRNA
ggatgtatatatatcattgctgt

SEQ ID NO: 15240 - DNA, 23 bp, Artificial Sequence
  X-linked inhibitor of apoptosis (XIAP) siRNA
gatgtatatatatcattgctgtt

SEQ ID NO: 15241 - DNA, 23 bp, Artificial Sequence
  X-linked inhibitor of apoptosis (XIAP) siRNA
atgtatatatatcattgctgtta

SEQ ID NO: 15242 - DNA, 23 bp, Artificial Sequence
  X-linked inhibitor of apoptosis (XIAP) siRNA
tgtatatatatcattgctgttag

SEQ ID NO: 15243 - DNA, 23 bp, Artificial Sequence
  X-linked inhibitor of apoptosis (XIAP) siRNA
gtatatatatcattgctgttaga

SEQ ID NO: 15244 - DNA, 23 bp, Artificial Sequence
  X-linked inhibitor of apoptosis (XIAP) siRNA
tatatatatcattgctgttagag

SEQ ID NO: 15245 - DNA, 23 bp, Artificial Sequence
  X-linked inhibitor of apoptosis (XIAP) siRNA
atatatatcattgctgttagaga

SEQ ID NO: 15246 - DNA, 23 bp, Artificial Sequence
  X-linked inhibitor of apoptosis (XIAP) siRNA
tatatatcattgctgttagagaa

SEQ ID NO: 15247 - DNA, 23 bp, Artificial Sequence
  X-linked inhibitor of apoptosis (XIAP) siRNA
atatatcattgctgttagagaaa

SEQ ID NO: 15248 - DNA, 23 bp, Artificial Sequence
  X-linked inhibitor of apoptosis (XIAP) siRNA
tatatcattgctgttagagaaat

SEQ ID NO: 15249 - DNA, 23 bp, Artificial Sequence
  X-linked inhibitor of apoptosis (XIAP) siRNA
atatcattgctgttagagaaatg

SEQ ID NO: 15250 - DNA, 23 bp, Artificial Sequence
  X-linked inhibitor of apoptosis (XIAP) siRNA
tatcattgctgttagagaaatga

SEQ ID NO: 15251 - DNA, 23 bp, Artificial Sequence
  X-linked inhibitor of apoptosis (XIAP) siRNA
atcattgctgttagagaaatgaa

SEQ ID NO: 15252 - DNA, 23 bp, Artificial Sequence
  X-linked inhibitor of apoptosis (XIAP) siRNA
tcattgctgttagagaaatgaaa

SEQ ID NO: 15253 - DNA, 23 bp, Artificial Sequence
  X-linked inhibitor of apoptosis (XIAP) siRNA
cattgctgttagagaaatgaaat

SEQ ID NO: 15254 - DNA, 23 bp, Artificial Sequence
  X-linked inhibitor of apoptosis (XIAP) siRNA
attgctgttagagaaatgaaata

SEQ ID NO: 15255 - DNA, 23 bp, Artificial Sequence
  X-linked inhibitor of apoptosis (XIAP) siRNA
ttgctgttagagaaatgaaataa

SEQ ID NO: 15256 - DNA, 23 bp, Artificial Sequence
  X-linked inhibitor of apoptosis (XIAP) siRNA
tgctgttagagaaatgaaataaa

SEQ ID NO: 15257 - DNA, 23 bp, Artificial Sequence
  X-linked inhibitor of apoptosis (XIAP) siRNA
gctgttagagaaatgaaataaaa

SEQ ID NO: 15258 - DNA, 23 bp, Artificial Sequence
  X-linked inhibitor of apoptosis (XIAP) siRNA
ctgttagagaaatgaaataaaat

SEQ ID NO: 15259 - DNA, 23 bp, Artificial Sequence
  X-linked inhibitor of apoptosis (XIAP) siRNA
tgttagagaaatgaaataaaatg

SEQ ID NO: 15260 - DNA, 23 bp, Artificial Sequence
  X-linked inhibitor of apoptosis (XIAP) siRNA
gttagagaaatgaaataaaatgg

SEQ ID NO: 15261 - DNA, 23 bp, Artificial Sequence
  X-linked inhibitor of apoptosis (XIAP) siRNA
ttagagaaatgaaataaaatggg

SEQ ID NO: 15262 - DNA, 23 bp, Artificial Sequence
  X-linked inhibitor of apoptosis (XIAP) siRNA
tagagaaatgaaataaaatgggg

SEQ ID NO: 15263 - DNA, 23 bp, Artificial Sequence
  X-linked inhibitor of apoptosis (XIAP) siRNA
agagaaatgaaataaaatggggc

SEQ ID NO: 15264 - DNA, 23 bp, Artificial Sequence
  X-linked inhibitor of apoptosis (XIAP) siRNA
gagaaatgaaataaaatggggct

SEQ ID NO: 15265 - DNA, 23 bp, Artificial Sequence
  X-linked inhibitor of apoptosis (XIAP) siRNA
agaaatgaaataaaatggggctg

SEQ ID NO: 15266 - DNA, 23 bp, Artificial Sequence
  X-linked inhibitor of apoptosis (XIAP) siRNA
gaaatgaaataaaatggggctgg

SEQ ID NO: 15267 - DNA, 23 bp, Artificial Sequence
  X-linked inhibitor of apoptosis (XIAP) siRNA
aaatgaaataaaatggggctggg

SEQ ID NO: 15268 - DNA, 23 bp, Artificial Sequence
  X-linked inhibitor of apoptosis (XIAP) siRNA
aatgaaataaaatggggctgggc

SEQ ID NO: 15269 - DNA, 23 bp, Artificial Sequence
  X-linked inhibitor of apoptosis (XIAP) siRNA
atgaaataaaatggggctgggct

SEQ ID NO: 15270 - DNA, 23 bp, Artificial Sequence
  X-linked inhibitor of apoptosis (XIAP) siRNA
tgaaataaaatggggctgggctc

SEQ ID NO: 15271 - DNA, 23 bp, Artificial Sequence
  X-linked inhibitor of apoptosis (XIAP) siRNA
gaaataaaatggggctgggctca

SEQ ID NO: 15272 - DNA, 23 bp, Artificial Sequence
  X-linked inhibitor of apoptosis (XIAP) siRNA
aaataaaatggggctgggctcag

SEQ ID NO: 15273 - DNA, 23 bp, Artificial Sequence
  X-linked inhibitor of apoptosis (XIAP) siRNA
aataaaatggggctgggctcagt

SEQ ID NO: 15274 - DNA, 23 bp, Artificial Sequence
  X-linked inhibitor of apoptosis (XIAP) siRNA
ataaaatggggctgggctcagtg

SEQ ID NO: 15275 - DNA, 23 bp, Artificial Sequence
  X-linked inhibitor of apoptosis (XIAP) siRNA
taaaatggggctgggctcagtgg

SEQ ID NO: 15276 - DNA, 23 bp, Artificial Sequence
  X-linked inhibitor of apoptosis (XIAP) siRNA
aaaatggggctgggctcagtggc

SEQ ID NO: 15277 - DNA, 23 bp, Artificial Sequence
  X-linked inhibitor of apoptosis (XIAP) siRNA
aaatggggctgggctcagtggct

SEQ ID NO: 15278 - DNA, 23 bp, Artificial Sequence
  X-linked inhibitor of apoptosis (XIAP) siRNA
aatggggctgggctcagtggctc

SEQ ID NO: 15279 - DNA, 23 bp, Artificial Sequence
  X-linked inhibitor of apoptosis (XIAP) siRNA
atggggctgggctcagtggctca

SEQ ID NO: 15280 - DNA, 23 bp, Artificial Sequence
  X-linked inhibitor of apoptosis (XIAP) siRNA
tggggctgggctcagtggctcac

SEQ ID NO: 15281 - DNA, 23 bp, Artificial Sequence
  X-linked inhibitor of apoptosis (XIAP) siRNA
ggggctgggctcagtggctcacg

SEQ ID NO: 15282 - DNA, 23 bp, Artificial Sequence
  X-linked inhibitor of apoptosis (XIAP) siRNA
gggctgggctcagtggctcacgc

SEQ ID NO: 15283 - DNA, 23 bp, Artificial Sequence
  X-linked inhibitor of apoptosis (XIAP) siRNA
ggctgggctcagtggctcacgcc

SEQ ID NO: 15284 - DNA, 23 bp, Artificial Sequence
  X-linked inhibitor of apoptosis (XIAP) siRNA
gctgggctcagtggctcacgcct

SEQ ID NO: 15285 - DNA, 23 bp, Artificial Sequence
  X-linked inhibitor of apoptosis (XIAP) siRNA
ctgggctcagtggctcacgcctg

SEQ ID NO: 15286 - DNA, 23 bp, Artificial Sequence
  X-linked inhibitor of apoptosis (XIAP) siRNA
tgggctcagtggctcacgcctgt

SEQ ID NO: 15287 - DNA, 23 bp, Artificial Sequence
  X-linked inhibitor of apoptosis (XIAP) siRNA
gggctcagtggctcacgcctgta

SEQ ID NO: 15288 - DNA, 23 bp, Artificial Sequence
  X-linked inhibitor of apoptosis (XIAP) siRNA
ggctcagtggctcacgcctgtaa

SEQ ID NO: 15289 - DNA, 23 bp, Artificial Sequence
  X-linked inhibitor of apoptosis (XIAP) siRNA
gctcagtggctcacgcctgtaat

SEQ ID NO: 15290 - DNA, 23 bp, Artificial Sequence
  X-linked inhibitor of apoptosis (XIAP) siRNA
ctcagtggctcacgcctgtaatc

SEQ ID NO: 15291 - DNA, 23 bp, Artificial Sequence
  X-linked inhibitor of apoptosis (XIAP) siRNA
tcagtggctcacgcctgtaatcc

SEQ ID NO: 15292 - DNA, 23 bp, Artificial Sequence
  X-linked inhibitor of apoptosis (XIAP) siRNA
cagtggctcacgcctgtaatccc

SEQ ID NO: 15293 - DNA, 23 bp, Artificial Sequence
  X-linked inhibitor of apoptosis (XIAP) siRNA
agtggctcacgcctgtaatccca

SEQ ID NO: 15294 - DNA, 23 bp, Artificial Sequence
  X-linked inhibitor of apoptosis (XIAP) siRNA
gtggctcacgcctgtaatcccag

SEQ ID NO: 15295 - DNA, 23 bp, Artificial Sequence
  X-linked inhibitor of apoptosis (XIAP) siRNA
tggctcacgcctgtaatcccagc

SEQ ID NO: 15296 - DNA, 23 bp, Artificial Sequence
  X-linked inhibitor of apoptosis (XIAP) siRNA
ggctcacgcctgtaatcccagca

SEQ ID NO: 15297 - DNA, 23 bp, Artificial Sequence
  X-linked inhibitor of apoptosis (XIAP) siRNA
gctcacgcctgtaatcccagcac

SEQ ID NO: 15298 - DNA, 23 bp, Artificial Sequence
  X-linked inhibitor of apoptosis (XIAP) siRNA
ctcacgcctgtaatcccagcact

SEQ ID NO: 15299 - DNA, 23 bp, Artificial Sequence
  X-linked inhibitor of apoptosis (XIAP) siRNA
tcacgcctgtaatcccagcactt

SEQ ID NO: 15300 - DNA, 23 bp, Artificial Sequence
  X-linked inhibitor of apoptosis (XIAP) siRNA
cacgcctgtaatcccagcacttt

SEQ ID NO: 15301 - DNA, 23 bp, Artificial Sequence
  X-linked inhibitor of apoptosis (XIAP) siRNA
acgcctgtaatcccagcactttg

SEQ ID NO: 15302 - DNA, 23 bp, Artificial Sequence
  X-linked inhibitor of apoptosis (XIAP) siRNA
cgcctgtaatcccagcactttgg

SEQ ID NO: 15303 - DNA, 23 bp, Artificial Sequence
  X-linked inhibitor of apoptosis (XIAP) siRNA
gcctgtaatcccagcactttggg

SEQ ID NO: 15304 - DNA, 23 bp, Artificial Sequence
  X-linked inhibitor of apoptosis (XIAP) siRNA
cctgtaatcccagcactttggga

SEQ ID NO: 15305 - DNA, 23 bp, Artificial Sequence
  X-linked inhibitor of apoptosis (XIAP) siRNA
ctgtaatcccagcactttgggag

SEQ ID NO: 15306 - DNA, 23 bp, Artificial Sequence
  X-linked inhibitor of apoptosis (XIAP) siRNA
tgtaatcccagcactttgggagg

SEQ ID NO: 15307 - DNA, 23 bp, Artificial Sequence
  X-linked inhibitor of apoptosis (XIAP) siRNA
gtaatcccagcactttgggaggc

SEQ ID NO: 15308 - DNA, 23 bp, Artificial Sequence
  X-linked inhibitor of apoptosis (XIAP) siRNA
taatcccagcactttgggaggct

SEQ ID NO: 15309 - DNA, 23 bp, Artificial Sequence
  X-linked inhibitor of apoptosis (XIAP) siRNA
aatcccagcactttgggaggctg

SEQ ID NO: 15310 - DNA, 23 bp, Artificial Sequence
  X-linked inhibitor of apoptosis (XIAP) siRNA
atcccagcactttgggaggctga

SEQ ID NO: 15311 - DNA, 23 bp, Artificial Sequence
  X-linked inhibitor of apoptosis (XIAP) siRNA
tcccagcactttgggaggctgag

SEQ ID NO: 15312 - DNA, 23 bp, Artificial Sequence
  X-linked inhibitor of apoptosis (XIAP) siRNA
cccagcactttgggaggctgagg

SEQ ID NO: 15313 - DNA, 23 bp, Artificial Sequence
  X-linked inhibitor of apoptosis (XIAP) siRNA
ccagcactttgggaggctgaggc

SEQ ID NO: 15314 - DNA, 23 bp, Artificial Sequence
  X-linked inhibitor of apoptosis (XIAP) siRNA
cagcactttgggaggctgaggca

SEQ ID NO: 15315 - DNA, 23 bp, Artificial Sequence
  X-linked inhibitor of apoptosis (XIAP) siRNA
agcactttgggaggctgaggcag

SEQ ID NO: 15316 - DNA, 23 bp, Artificial Sequence
  X-linked inhibitor of apoptosis (XIAP) siRNA
gcactttgggaggctgaggcagg

SEQ ID NO: 15317 - DNA, 23 bp, Artificial Sequence
  X-linked inhibitor of apoptosis (XIAP) siRNA
cactttgggaggctgaggcaggt

SEQ ID NO: 15318 - DNA, 23 bp, Artificial Sequence
  X-linked inhibitor of apoptosis (XIAP) siRNA
actttgggaggctgaggcaggtg

SEQ ID NO: 15319 - DNA, 23 bp, Artificial Sequence
  X-linked inhibitor of apoptosis (XIAP) siRNA
ctttgggaggctgaggcaggtgg

SEQ ID NO: 15320 - DNA, 23 bp, Artificial Sequence
  X-linked inhibitor of apoptosis (XIAP) siRNA
tttgggaggctgaggcaggtgga

SEQ ID NO: 15321 - DNA, 23 bp, Artificial Sequence
  X-linked inhibitor of apoptosis (XIAP) siRNA
ttgggaggctgaggcaggtggat

SEQ ID NO: 15322 - DNA, 23 bp, Artificial Sequence
  X-linked inhibitor of apoptosis (XIAP) siRNA
tgggaggctgaggcaggtggatc

SEQ ID NO: 15323 - DNA, 23 bp, Artificial Sequence
  X-linked inhibitor of apoptosis (XIAP) siRNA
gggaggctgaggcaggtggatca

SEQ ID NO: 15324 - DNA, 23 bp, Artificial Sequence
  X-linked inhibitor of apoptosis (XIAP) siRNA
ggaggctgaggcaggtggatcac

SEQ ID NO: 15325 - DNA, 23 bp, Artificial Sequence
  X-linked inhibitor of apoptosis (XIAP) siRNA
gaggctgaggcaggtggatcacg

SEQ ID NO: 15326 - DNA, 23 bp, Artificial Sequence
  X-linked inhibitor of apoptosis (XIAP) siRNA
aggctgaggcaggtggatcacga

SEQ ID NO: 15327 - DNA, 23 bp, Artificial Sequence
  X-linked inhibitor of apoptosis (XIAP) siRNA
ggctgaggcaggtggatcacgag

SEQ ID NO: 15328 - DNA, 23 bp, Artificial Sequence
  X-linked inhibitor of apoptosis (XIAP) siRNA
gctgaggcaggtggatcacgagg

SEQ ID NO: 15329 - DNA, 23 bp, Artificial Sequence
  X-linked inhibitor of apoptosis (XIAP) siRNA
ctgaggcaggtggatcacgaggt

SEQ ID NO: 15330 - DNA, 23 bp, Artificial Sequence
  X-linked inhibitor of apoptosis (XIAP) siRNA
tgaggcaggtggatcacgaggtc

SEQ ID NO: 15331 - DNA, 23 bp, Artificial Sequence
  X-linked inhibitor of apoptosis (XIAP) siRNA
gaggcaggtggatcacgaggtca

SEQ ID NO: 15332 - DNA, 23 bp, Artificial Sequence
  X-linked inhibitor of apoptosis (XIAP) siRNA
aggcaggtggatcacgaggtcag

SEQ ID NO: 15333 - DNA, 23 bp, Artificial Sequence
  X-linked inhibitor of apoptosis (XIAP) siRNA
ggcaggtggatcacgaggtcagg

SEQ ID NO: 15334 - DNA, 23 bp, Artificial Sequence
  X-linked inhibitor of apoptosis (XIAP) siRNA
gcaggtggatcacgaggtcagga

SEQ ID NO: 15335 - DNA, 23 bp, Artificial Sequence
  X-linked inhibitor of apoptosis (XIAP) siRNA
caggtggatcacgaggtcaggag

SEQ ID NO: 15336 - DNA, 23 bp, Artificial Sequence
  X-linked inhibitor of apoptosis (XIAP) siRNA
aggtggatcacgaggtcaggaga

SEQ ID NO: 15337 - DNA, 23 bp, Artificial Sequence
  X-linked inhibitor of apoptosis (XIAP) siRNA
ggtggatcacgaggtcaggagat

SEQ ID NO: 15338 - DNA, 23 bp, Artificial Sequence
  X-linked inhibitor of apoptosis (XIAP) siRNA
gtggatcacgaggtcaggagatc

SEQ ID NO: 15339 - DNA, 23 bp, Artificial Sequence
  X-linked inhibitor of apoptosis (XIAP) siRNA
tggatcacgaggtcaggagatcg

SEQ ID NO: 15340 - DNA, 23 bp, Artificial Sequence
  X-linked inhibitor of apoptosis (XIAP) siRNA
ggatcacgaggtcaggagatcga

SEQ ID NO: 15341 - DNA, 23 bp, Artificial Sequence
  X-linked inhibitor of apoptosis (XIAP) siRNA
gatcacgaggtcaggagatcgag

SEQ ID NO: 15342 - DNA, 23 bp, Artificial Sequence
  X-linked inhibitor of apoptosis (XIAP) siRNA
atcacgaggtcaggagatcgaga

SEQ ID NO: 15343 - DNA, 23 bp, Artificial Sequence
  X-linked inhibitor of apoptosis (XIAP) siRNA
tcacgaggtcaggagatcgagac

SEQ ID NO: 15344 - DNA, 23 bp, Artificial Sequence
  X-linked inhibitor of apoptosis (XIAP) siRNA
cacgaggtcaggagatcgagacc

SEQ ID NO: 15345 - DNA, 23 bp, Artificial Sequence
  X-linked inhibitor of apoptosis (XIAP) siRNA
acgaggtcaggagatcgagacca

SEQ ID NO: 15346 - DNA, 23 bp, Artificial Sequence
  X-linked inhibitor of apoptosis (XIAP) siRNA
cgaggtcaggagatcgagaccat

SEQ ID NO: 15347 - DNA, 23 bp, Artificial Sequence
  X-linked inhibitor of apoptosis (XIAP) siRNA
gaggtcaggagatcgagaccatc

SEQ ID NO: 15348 - DNA, 23 bp, Artificial Sequence
  X-linked inhibitor of apoptosis (XIAP) siRNA
aggtcaggagatcgagaccatcc

SEQ ID NO: 15349 - DNA, 23 bp, Artificial Sequence
  X-linked inhibitor of apoptosis (XIAP) siRNA
ggtcaggagatcgagaccatcct

SEQ ID NO: 15350 - DNA, 23 bp, Artificial Sequence
  X-linked inhibitor of apoptosis (XIAP) siRNA
gtcaggagatcgagaccatcctg

SEQ ID NO: 15351 - DNA, 23 bp, Artificial Sequence
  X-linked inhibitor of apoptosis (XIAP) siRNA
tcaggagatcgagaccatcctgg

SEQ ID NO: 15352 - DNA, 23 bp, Artificial Sequence
  X-linked inhibitor of apoptosis (XIAP) siRNA
caggagatcgagaccatcctggc

SEQ ID NO: 15353 - DNA, 23 bp, Artificial Sequence
  X-linked inhibitor of apoptosis (XIAP) siRNA
aggagatcgagaccatcctggct

SEQ ID NO: 15354 - DNA, 23 bp, Artificial Sequence
  X-linked inhibitor of apoptosis (XIAP) siRNA
ggagatcgagaccatcctggcta

SEQ ID NO: 15355 - DNA, 23 bp, Artificial Sequence
  X-linked inhibitor of apoptosis (XIAP) siRNA
gagatcgagaccatcctggctaa

SEQ ID NO: 15356 - DNA, 23 bp, Artificial Sequence
  X-linked inhibitor of apoptosis (XIAP) siRNA
agatcgagaccatcctggctaac

SEQ ID NO: 15357 - DNA, 23 bp, Artificial Sequence
  X-linked inhibitor of apoptosis (XIAP) siRNA
gatcgagaccatcctggctaaca

SEQ ID NO: 15358 - DNA, 23 bp, Artificial Sequence
  X-linked inhibitor of apoptosis (XIAP) siRNA
atcgagaccatcctggctaacac

SEQ ID NO: 15359 - DNA, 23 bp, Artificial Sequence
  X-linked inhibitor of apoptosis (XIAP) siRNA
tcgagaccatcctggctaacacg

SEQ ID NO: 15360 - DNA, 23 bp, Artificial Sequence
  X-linked inhibitor of apoptosis (XIAP) siRNA
cgagaccatcctggctaacacgg

SEQ ID NO: 15361 - DNA, 23 bp, Artificial Sequence
  X-linked inhibitor of apoptosis (XIAP) siRNA
gagaccatcctggctaacacggt

SEQ ID NO: 15362 - DNA, 23 bp, Artificial Sequence
  X-linked inhibitor of apoptosis (XIAP) siRNA
agaccatcctggctaacacggtg

SEQ ID NO: 15363 - DNA, 23 bp, Artificial Sequence
  X-linked inhibitor of apoptosis (XIAP) siRNA
gaccatcctggctaacacggtga

SEQ ID NO: 15364 - DNA, 23 bp, Artificial Sequence
  X-linked inhibitor of apoptosis (XIAP) siRNA
accatcctggctaacacggtgaa

SEQ ID NO: 15365 - DNA, 23 bp, Artificial Sequence
  X-linked inhibitor of apoptosis (XIAP) siRNA
ccatcctggctaacacggtgaaa

SEQ ID NO: 15366 - DNA, 23 bp, Artificial Sequence
  X-linked inhibitor of apoptosis (XIAP) siRNA
catcctggctaacacggtgaaac

SEQ ID NO: 15367 - DNA, 23 bp, Artificial Sequence
  X-linked inhibitor of apoptosis (XIAP) siRNA
atcctggctaacacggtgaaacc

SEQ ID NO: 15368 - DNA, 23 bp, Artificial Sequence
  X-linked inhibitor of apoptosis (XIAP) siRNA
tcctggctaacacggtgaaaccc

SEQ ID NO: 15369 - DNA, 23 bp, Artificial Sequence
  X-linked inhibitor of apoptosis (XIAP) siRNA
cctggctaacacggtgaaacccc

SEQ ID NO: 15370 - DNA, 23 bp, Artificial Sequence
  X-linked inhibitor of apoptosis (XIAP) siRNA
ctggctaacacggtgaaaccccg

SEQ ID NO: 15371 - DNA, 23 bp, Artificial Sequence
  X-linked inhibitor of apoptosis (XIAP) siRNA
tggctaacacggtgaaaccccgt

SEQ ID NO: 15372 - DNA, 23 bp, Artificial Sequence
  X-linked inhibitor of apoptosis (XIAP) siRNA
ggctaacacggtgaaaccccgtc

SEQ ID NO: 15373 - DNA, 23 bp, Artificial Sequence
  X-linked inhibitor of apoptosis (XIAP) siRNA
gctaacacggtgaaaccccgtct

SEQ ID NO: 15374 - DNA, 23 bp, Artificial Sequence
  X-linked inhibitor of apoptosis (XIAP) siRNA
ctaacacggtgaaaccccgtctc

SEQ ID NO: 15375 - DNA, 23 bp, Artificial Sequence
  X-linked inhibitor of apoptosis (XIAP) siRNA
taacacggtgaaaccccgtctct

SEQ ID NO: 15376 - DNA, 23 bp, Artificial Sequence
  X-linked inhibitor of apoptosis (XIAP) siRNA
aacacggtgaaaccccgtctcta

SEQ ID NO: 15377 - DNA, 23 bp, Artificial Sequence
  X-linked inhibitor of apoptosis (XIAP) siRNA
acacggtgaaaccccgtctctac

SEQ ID NO: 15378 - DNA, 23 bp, Artificial Sequence
  X-linked inhibitor of apoptosis (XIAP) siRNA
cacggtgaaaccccgtctctact

SEQ ID NO: 15379 - DNA, 23 bp, Artificial Sequence
  X-linked inhibitor of apoptosis (XIAP) siRNA
acggtgaaaccccgtctctacta

SEQ ID NO: 15380 - DNA, 23 bp, Artificial Sequence
  X-linked inhibitor of apoptosis (XIAP) siRNA
cggtgaaaccccgtctctactaa

SEQ ID NO: 15381 - DNA, 23 bp, Artificial Sequence
  X-linked inhibitor of apoptosis (XIAP) siRNA
ggtgaaaccccgtctctactaaa

SEQ ID NO: 15382 - DNA, 23 bp, Artificial Sequence
  X-linked inhibitor of apoptosis (XIAP) siRNA
gtgaaaccccgtctctactaaaa

SEQ ID NO: 15383 - DNA, 23 bp, Artificial Sequence
  X-linked inhibitor of apoptosis (XIAP) siRNA
tgaaaccccgtctctactaaaaa

SEQ ID NO: 15384 - DNA, 23 bp, Artificial Sequence
  X-linked inhibitor of apoptosis (XIAP) siRNA
gaaaccccgtctctactaaaaaa

SEQ ID NO: 15385 - DNA, 23 bp, Artificial Sequence
  X-linked inhibitor of apoptosis (XIAP) siRNA
aaaccccgtctctactaaaaaac

SEQ ID NO: 15386 - DNA, 23 bp, Artificial Sequence
  X-linked inhibitor of apoptosis (XIAP) siRNA
aaccccgtctctactaaaaaaca

SEQ ID NO: 15387 - DNA, 23 bp, Artificial Sequence
  X-linked inhibitor of apoptosis (XIAP) siRNA
accccgtctctactaaaaaacag

SEQ ID NO: 15388 - DNA, 23 bp, Artificial Sequence
  X-linked inhibitor of apoptosis (XIAP) siRNA
ccccgtctctactaaaaaacaga

SEQ ID NO: 15389 - DNA, 23 bp, Artificial Sequence
  X-linked inhibitor of apoptosis (XIAP) siRNA
cccgtctctactaaaaaacagaa

SEQ ID NO: 15390 - DNA, 23 bp, Artificial Sequence
  X-linked inhibitor of apoptosis (XIAP) siRNA
ccgtctctactaaaaaacagaaa

SEQ ID NO: 15391 - DNA, 23 bp, Artificial Sequence
  X-linked inhibitor of apoptosis (XIAP) siRNA
cgtctctactaaaaaacagaaaa

SEQ ID NO: 15392 - DNA, 23 bp, Artificial Sequence
  X-linked inhibitor of apoptosis (XIAP) siRNA
gtctctactaaaaaacagaaaat

SEQ ID NO: 15393 - DNA, 23 bp, Artificial Sequence
  X-linked inhibitor of apoptosis (XIAP) siRNA
tctctactaaaaaacagaaaatt

SEQ ID NO: 15394 - DNA, 23 bp, Artificial Sequence
  X-linked inhibitor of apoptosis (XIAP) siRNA
ctctactaaaaaacagaaaatta

SEQ ID NO: 15395 - DNA, 23 bp, Artificial Sequence
  X-linked inhibitor of apoptosis (XIAP) siRNA
tctactaaaaaacagaaaattag

SEQ ID NO: 15396 - DNA, 23 bp, Artificial Sequence
  X-linked inhibitor of apoptosis (XIAP) siRNA
ctactaaaaaacagaaaattagc

SEQ ID NO: 15397 - DNA, 23 bp, Artificial Sequence
  X-linked inhibitor of apoptosis (XIAP) siRNA
tactaaaaaacagaaaattagcc

SEQ ID NO: 15398 - DNA, 23 bp, Artificial Sequence
  X-linked inhibitor of apoptosis (XIAP) siRNA
actaaaaaacagaaaattagccg

SEQ ID NO: 15399 - DNA, 23 bp, Artificial Sequence
  X-linked inhibitor of apoptosis (XIAP) siRNA
ctaaaaaacagaaaattagccgg

SEQ ID NO: 15400 - DNA, 23 bp, Artificial Sequence
  X-linked inhibitor of apoptosis (XIAP) siRNA
taaaaaacagaaaattagccggg

SEQ ID NO: 15401 - DNA, 23 bp, Artificial Sequence
  X-linked inhibitor of apoptosis (XIAP) siRNA
aaaaaacagaaaattagccgggc

SEQ ID NO: 15402 - DNA, 23 bp, Artificial Sequence
  X-linked inhibitor of apoptosis (XIAP) siRNA
aaaaacagaaaattagccgggcg

SEQ ID NO: 15403 - DNA, 23 bp, Artificial Sequence
  X-linked inhibitor of apoptosis (XIAP) siRNA
aaaacagaaaattagccgggcgt

SEQ ID NO: 15404 - DNA, 23 bp, Artificial Sequence
  X-linked inhibitor of apoptosis (XIAP) siRNA
aaacagaaaattagccgggcgtg

SEQ ID NO: 15405 - DNA, 23 bp, Artificial Sequence
  X-linked inhibitor of apoptosis (XIAP) siRNA
aacagaaaattagccgggcgtgg

SEQ ID NO: 15406 - DNA, 23 bp, Artificial Sequence
  X-linked inhibitor of apoptosis (XIAP) siRNA
acagaaaattagccgggcgtggt

SEQ ID NO: 15407 - DNA, 23 bp, Artificial Sequence
  X-linked inhibitor of apoptosis (XIAP) siRNA
cagaaaattagccgggcgtggtg

SEQ ID NO: 15408 - DNA, 23 bp, Artificial Sequence
  X-linked inhibitor of apoptosis (XIAP) siRNA
agaaaattagccgggcgtggtgg

SEQ ID NO: 15409 - DNA, 23 bp, Artificial Sequence
  X-linked inhibitor of apoptosis (XIAP) siRNA
gaaaattagccgggcgtggtggc

SEQ ID NO: 15410 - DNA, 23 bp, Artificial Sequence
  X-linked inhibitor of apoptosis (XIAP) siRNA
aaaattagccgggcgtggtggcg

SEQ ID NO: 15411 - DNA, 23 bp, Artificial Sequence
  X-linked inhibitor of apoptosis (XIAP) siRNA
aaattagccgggcgtggtggcgg

SEQ ID NO: 15412 - DNA, 23 bp, Artificial Sequence
  X-linked inhibitor of apoptosis (XIAP) siRNA
aattagccgggcgtggtggcggg

SEQ ID NO: 15413 - DNA, 23 bp, Artificial Sequence
  X-linked inhibitor of apoptosis (XIAP) siRNA
attagccgggcgtggtggcgggc

SEQ ID NO: 15414 - DNA, 23 bp, Artificial Sequence
  X-linked inhibitor of apoptosis (XIAP) siRNA
ttagccgggcgtggtggcgggcg

SEQ ID NO: 15415 - DNA, 23 bp, Artificial Sequence
  X-linked inhibitor of apoptosis (XIAP) siRNA
cgggcgcctgtagtcccagctac

SEQ ID NO: 15416 - DNA, 23 bp, Artificial Sequence
  X-linked inhibitor of apoptosis (XIAP) siRNA
gggcgcctgtagtcccagctact

SEQ ID NO: 15417 - DNA, 23 bp, Artificial Sequence
  X-linked inhibitor of apoptosis (XIAP) siRNA
ggcgcctgtagtcccagctactc

SEQ ID NO: 15418 - DNA, 23 bp, Artificial Sequence
  X-linked inhibitor of apoptosis (XIAP) siRNA
gcgcctgtagtcccagctactcg

SEQ ID NO: 15419 - DNA, 23 bp, Artificial Sequence
  X-linked inhibitor of apoptosis (XIAP) siRNA
cgcctgtagtcccagctactcgg

SEQ ID NO: 15420 - DNA, 23 bp, Artificial Sequence
  X-linked inhibitor of apoptosis (XIAP) siRNA
gcctgtagtcccagctactcggg

SEQ ID NO: 15421 - DNA, 23 bp, Artificial Sequence
  X-linked inhibitor of apoptosis (XIAP) siRNA
cctgtagtcccagctactcggga

SEQ ID NO: 15422 - DNA, 23 bp, Artificial Sequence
  X-linked inhibitor of apoptosis (XIAP) siRNA
ctgtagtcccagctactcgggag

SEQ ID NO: 15423 - DNA, 23 bp, Artificial Sequence
  X-linked inhibitor of apoptosis (XIAP) siRNA
tgtagtcccagctactcgggagg

SEQ ID NO: 15424 - DNA, 23 bp, Artificial Sequence
  X-linked inhibitor of apoptosis (XIAP) siRNA
gtagtcccagctactcgggaggc

SEQ ID NO: 15425 - DNA, 23 bp, Artificial Sequence
  X-linked inhibitor of apoptosis (XIAP) siRNA
tagtcccagctactcgggaggct

SEQ ID NO: 15426 - DNA, 23 bp, Artificial Sequence
  X-linked inhibitor of apoptosis (XIAP) siRNA
agtcccagctactcgggaggctg

SEQ ID NO: 15427 - DNA, 23 bp, Artificial Sequence
  X-linked inhibitor of apoptosis (XIAP) siRNA
gtcccagctactcgggaggctga

SEQ ID NO: 15428 - DNA, 23 bp, Artificial Sequence
  X-linked inhibitor of apoptosis (XIAP) siRNA
tcccagctactcgggaggctgag

SEQ ID NO: 15429 - DNA, 23 bp, Artificial Sequence
  X-linked inhibitor of apoptosis (XIAP) siRNA
cccagctactcgggaggctgagg

SEQ ID NO: 15430 - DNA, 23 bp, Artificial Sequence
  X-linked inhibitor of apoptosis (XIAP) siRNA
ccagctactcgggaggctgaggc

SEQ ID NO: 15431 - DNA, 23 bp, Artificial Sequence
  X-linked inhibitor of apoptosis (XIAP) siRNA
cagctactcgggaggctgaggca

SEQ ID NO: 15432 - DNA, 23 bp, Artificial Sequence
  X-linked inhibitor of apoptosis (XIAP) siRNA
agctactcgggaggctgaggcag

SEQ ID NO: 15433 - DNA, 23 bp, Artificial Sequence
  X-linked inhibitor of apoptosis (XIAP) siRNA
gctactcgggaggctgaggcagg

SEQ ID NO: 15434 - DNA, 23 bp, Artificial Sequence
  X-linked inhibitor of apoptosis (XIAP) siRNA
ctactcgggaggctgaggcagga

SEQ ID NO: 15435 - DNA, 23 bp, Artificial Sequence
  X-linked inhibitor of apoptosis (XIAP) siRNA
tactcgggaggctgaggcaggag

SEQ ID NO: 15436 - DNA, 23 bp, Artificial Sequence
  X-linked inhibitor of apoptosis (XIAP) siRNA
actcgggaggctgaggcaggaga

SEQ ID NO: 15437 - DNA, 23 bp, Artificial Sequence
  X-linked inhibitor of apoptosis (XIAP) siRNA
ctcgggaggctgaggcaggagaa

SEQ ID NO: 15438 - DNA, 23 bp, Artificial Sequence
  X-linked inhibitor of apoptosis (XIAP) siRNA
tcgggaggctgaggcaggagaat

SEQ ID NO: 15439 - DNA, 23 bp, Artificial Sequence
  X-linked inhibitor of apoptosis (XIAP) siRNA
cgggaggctgaggcaggagaatg

SEQ ID NO: 15440 - DNA, 23 bp, Artificial Sequence
  X-linked inhibitor of apoptosis (XIAP) siRNA
gggaggctgaggcaggagaatgg

SEQ ID NO: 15441 - DNA, 23 bp, Artificial Sequence
  X-linked inhibitor of apoptosis (XIAP) siRNA
ggaggctgaggcaggagaatggt

SEQ ID NO: 15442 - DNA, 23 bp, Artificial Sequence
  X-linked inhibitor of apoptosis (XIAP) siRNA
gaggctgaggcaggagaatggtg

SEQ ID NO: 15443 - DNA, 23 bp, Artificial Sequence
  X-linked inhibitor of apoptosis (XIAP) siRNA
aggctgaggcaggagaatggtgt

SEQ ID NO: 15444 - DNA, 23 bp, Artificial Sequence
  X-linked inhibitor of apoptosis (XIAP) siRNA
ggctgaggcaggagaatggtgtg

SEQ ID NO: 15445 - DNA, 23 bp, Artificial Sequence
  X-linked inhibitor of apoptosis (XIAP) siRNA
gctgaggcaggagaatggtgtga

SEQ ID NO: 15446 - DNA, 23 bp, Artificial Sequence
  X-linked inhibitor of apoptosis (XIAP) siRNA
ctgaggcaggagaatggtgtgaa

SEQ ID NO: 15447 - DNA, 23 bp, Artificial Sequence
  X-linked inhibitor of apoptosis (XIAP) siRNA
tgaggcaggagaatggtgtgaac

SEQ ID NO: 15448 - DNA, 23 bp, Artificial Sequence
  X-linked inhibitor of apoptosis (XIAP) siRNA
gaggcaggagaatggtgtgaacc

SEQ ID NO: 15449 - DNA, 23 bp, Artificial Sequence
  X-linked inhibitor of apoptosis (XIAP) siRNA
aggcaggagaatggtgtgaaccc

SEQ ID NO: 15450 - DNA, 23 bp, Artificial Sequence
  X-linked inhibitor of apoptosis (XIAP) siRNA
ggcaggagaatggtgtgaacccg

SEQ ID NO: 15451 - DNA, 23 bp, Artificial Sequence
  X-linked inhibitor of apoptosis (XIAP) siRNA
gcaggagaatggtgtgaacccgg

SEQ ID NO: 15452 - DNA, 23 bp, Artificial Sequence
  X-linked inhibitor of apoptosis (XIAP) siRNA
caggagaatggtgtgaacccggg

SEQ ID NO: 15453 - DNA, 23 bp, Artificial Sequence
  X-linked inhibitor of apoptosis (XIAP) siRNA
aggagaatggtgtgaacccggga

SEQ ID NO: 15454 - DNA, 23 bp, Artificial Sequence
  X-linked inhibitor of apoptosis (XIAP) siRNA
ggagaatggtgtgaacccgggag

SEQ ID NO: 15455 - DNA, 23 bp, Artificial Sequence
  X-linked inhibitor of apoptosis (XIAP) siRNA
gagaatggtgtgaacccgggagg

SEQ ID NO: 15456 - DNA, 23 bp, Artificial Sequence
  X-linked inhibitor of apoptosis (XIAP) siRNA
agaatggtgtgaacccgggaggc

SEQ ID NO: 15457 - DNA, 23 bp, Artificial Sequence
  X-linked inhibitor of apoptosis (XIAP) siRNA
gaatggtgtgaacccgggaggca

SEQ ID NO: 15458 - DNA, 23 bp, Artificial Sequence
  X-linked inhibitor of apoptosis (XIAP) siRNA
aatggtgtgaacccgggaggcag

SEQ ID NO: 15459 - DNA, 23 bp, Artificial Sequence
  X-linked inhibitor of apoptosis (XIAP) siRNA
atggtgtgaacccgggaggcaga

SEQ ID NO: 15460 - DNA, 23 bp, Artificial Sequence
  X-linked inhibitor of apoptosis (XIAP) siRNA
tggtgtgaacccgggaggcagag

SEQ ID NO: 15461 - DNA, 23 bp, Artificial Sequence
  X-linked inhibitor of apoptosis (XIAP) siRNA
ggtgtgaacccgggaggcagagc

SEQ ID NO: 15462 - DNA, 23 bp, Artificial Sequence
  X-linked inhibitor of apoptosis (XIAP) siRNA
gtgtgaacccgggaggcagagct

SEQ ID NO: 15463 - DNA, 23 bp, Artificial Sequence
  X-linked inhibitor of apoptosis (XIAP) siRNA
tgtgaacccgggaggcagagctt

SEQ ID NO: 15464 - DNA, 23 bp, Artificial Sequence
  X-linked inhibitor of apoptosis (XIAP) siRNA
gtgaacccgggaggcagagcttg

SEQ ID NO: 15465 - DNA, 23 bp, Artificial Sequence
  X-linked inhibitor of apoptosis (XIAP) siRNA
tgaacccgggaggcagagcttgc

SEQ ID NO: 15466 - DNA, 23 bp, Artificial Sequence
  X-linked inhibitor of apoptosis (XIAP) siRNA
gaacccgggaggcagagcttgca

SEQ ID NO: 15467 - DNA, 23 bp, Artificial Sequence
  X-linked inhibitor of apoptosis (XIAP) siRNA
aacccgggaggcagagcttgcag

SEQ ID NO: 15468 - DNA, 23 bp, Artificial Sequence
  X-linked inhibitor of apoptosis (XIAP) siRNA
acccgggaggcagagcttgcagt

SEQ ID NO: 15469 - DNA, 23 bp, Artificial Sequence
  X-linked inhibitor of apoptosis (XIAP) siRNA
cccgggaggcagagcttgcagtg

SEQ ID NO: 15470 - DNA, 23 bp, Artificial Sequence
  X-linked inhibitor of apoptosis (XIAP) siRNA
ccgggaggcagagcttgcagtga

SEQ ID NO: 15471 - DNA, 23 bp, Artificial Sequence
  X-linked inhibitor of apoptosis (XIAP) siRNA
cgggaggcagagcttgcagtgag

SEQ ID NO: 15472 - DNA, 23 bp, Artificial Sequence
  X-linked inhibitor of apoptosis (XIAP) siRNA
gggaggcagagcttgcagtgagc

SEQ ID NO: 15473 - DNA, 23 bp, Artificial Sequence
  X-linked inhibitor of apoptosis (XIAP) siRNA
ggaggcagagcttgcagtgagcc

SEQ ID NO: 15474 - DNA, 23 bp, Artificial Sequence
  X-linked inhibitor of apoptosis (XIAP) siRNA
gaggcagagcttgcagtgagccg

SEQ ID NO: 15475 - DNA, 23 bp, Artificial Sequence
  X-linked inhibitor of apoptosis (XIAP) siRNA
aggcagagcttgcagtgagccga

SEQ ID NO: 15476 - DNA, 23 bp, Artificial Sequence
  X-linked inhibitor of apoptosis (XIAP) siRNA
ggcagagcttgcagtgagccgag

SEQ ID NO: 15477 - DNA, 23 bp, Artificial Sequence
  X-linked inhibitor of apoptosis (XIAP) siRNA
gcagagcttgcagtgagccgaga

SEQ ID NO: 15478 - DNA, 23 bp, Artificial Sequence
  X-linked inhibitor of apoptosis (XIAP) siRNA
cagagcttgcagtgagccgagat

SEQ ID NO: 15479 - DNA, 23 bp, Artificial Sequence
  X-linked inhibitor of apoptosis (XIAP) siRNA
agagcttgcagtgagccgagatc

SEQ ID NO: 15480 - DNA, 23 bp, Artificial Sequence
  X-linked inhibitor of apoptosis (XIAP) siRNA
gagcttgcagtgagccgagatct

SEQ ID NO: 15481 - DNA, 23 bp, Artificial Sequence
  X-linked inhibitor of apoptosis (XIAP) siRNA
agcttgcagtgagccgagatctc

SEQ ID NO: 15482 - DNA, 23 bp, Artificial Sequence
  X-linked inhibitor of apoptosis (XIAP) siRNA
gcttgcagtgagccgagatctcg

SEQ ID NO: 15483 - DNA, 23 bp, Artificial Sequence
  X-linked inhibitor of apoptosis (XIAP) siRNA
cttgcagtgagccgagatctcgc

SEQ ID NO: 15484 - DNA, 23 bp, Artificial Sequence
  X-linked inhibitor of apoptosis (XIAP) siRNA
ttgcagtgagccgagatctcgcc

SEQ ID NO: 15485 - DNA, 23 bp, Artificial Sequence
  X-linked inhibitor of apoptosis (XIAP) siRNA
tgcagtgagccgagatctcgcca

SEQ ID NO: 15486 - DNA, 23 bp, Artificial Sequence
  X-linked inhibitor of apoptosis (XIAP) siRNA
gcagtgagccgagatctcgccac

SEQ ID NO: 15487 - DNA, 23 bp, Artificial Sequence
  X-linked inhibitor of apoptosis (XIAP) siRNA
cagtgagccgagatctcgccact

SEQ ID NO: 15488 - DNA, 23 bp, Artificial Sequence
  X-linked inhibitor of apoptosis (XIAP) siRNA
agtgagccgagatctcgccactg

SEQ ID NO: 15489 - DNA, 23 bp, Artificial Sequence
  X-linked inhibitor of apoptosis (XIAP) siRNA
gtgagccgagatctcgccactgc

SEQ ID NO: 15490 - DNA, 23 bp, Artificial Sequence
  X-linked inhibitor of apoptosis (XIAP) siRNA
tgagccgagatctcgccactgca

SEQ ID NO: 15491 - DNA, 23 bp, Artificial Sequence
  X-linked inhibitor of apoptosis (XIAP) siRNA
gagccgagatctcgccactgcac

SEQ ID NO: 15492 - DNA, 23 bp, Artificial Sequence
  X-linked inhibitor of apoptosis (XIAP) siRNA
agccgagatctcgccactgcact

SEQ ID NO: 15493 - DNA, 23 bp, Artificial Sequence
  X-linked inhibitor of apoptosis (XIAP) siRNA
gccgagatctcgccactgcactc

SEQ ID NO: 15494 - DNA, 23 bp, Artificial Sequence
  X-linked inhibitor of apoptosis (XIAP) siRNA
ccgagatctcgccactgcactcc

SEQ ID NO: 15495 - DNA, 23 bp, Artificial Sequence
  X-linked inhibitor of apoptosis (XIAP) siRNA
cgagatctcgccactgcactcca

SEQ ID NO: 15496 - DNA, 23 bp, Artificial Sequence
  X-linked inhibitor of apoptosis (XIAP) siRNA
gagatctcgccactgcactccag

SEQ ID NO: 15497 - DNA, 23 bp, Artificial Sequence
  X-linked inhibitor of apoptosis (XIAP) siRNA
agatctcgccactgcactccagc

SEQ ID NO: 15498 - DNA, 23 bp, Artificial Sequence
  X-linked inhibitor of apoptosis (XIAP) siRNA
gatctcgccactgcactccagcc

SEQ ID NO: 15499 - DNA, 23 bp, Artificial Sequence
  X-linked inhibitor of apoptosis (XIAP) siRNA
atctcgccactgcactccagcct

SEQ ID NO: 15500 - DNA, 23 bp, Artificial Sequence
  X-linked inhibitor of apoptosis (XIAP) siRNA
tctcgccactgcactccagcctg

SEQ ID NO: 15501 - DNA, 23 bp, Artificial Sequence
  X-linked inhibitor of apoptosis (XIAP) siRNA
ctcgccactgcactccagcctgg

SEQ ID NO: 15502 - DNA, 23 bp, Artificial Sequence
  X-linked inhibitor of apoptosis (XIAP) siRNA
tcgccactgcactccagcctggg

SEQ ID NO: 15503 - DNA, 23 bp, Artificial Sequence
  X-linked inhibitor of apoptosis (XIAP) siRNA
cgccactgcactccagcctgggc

SEQ ID NO: 15504 - DNA, 23 bp, Artificial Sequence
  X-linked inhibitor of apoptosis (XIAP) siRNA
gccactgcactccagcctgggca

SEQ ID NO: 15505 - DNA, 23 bp, Artificial Sequence
  X-linked inhibitor of apoptosis (XIAP) siRNA
ccactgcactccagcctgggcaa

SEQ ID NO: 15506 - DNA, 23 bp, Artificial Sequence
  X-linked inhibitor of apoptosis (XIAP) siRNA
cactgcactccagcctgggcaac

SEQ ID NO: 15507 - DNA, 23 bp, Artificial Sequence
  X-linked inhibitor of apoptosis (XIAP) siRNA
actgcactccagcctgggcaaca

SEQ ID NO: 15508 - DNA, 23 bp, Artificial Sequence
  X-linked inhibitor of apoptosis (XIAP) siRNA
ctgcactccagcctgggcaacag

SEQ ID NO: 15509 - DNA, 23 bp, Artificial Sequence
  X-linked inhibitor of apoptosis (XIAP) siRNA
tgcactccagcctgggcaacaga

SEQ ID NO: 15510 - DNA, 23 bp, Artificial Sequence
  X-linked inhibitor of apoptosis (XIAP) siRNA
gcactccagcctgggcaacagag

SEQ ID NO: 15511 - DNA, 23 bp, Artificial Sequence
  X-linked inhibitor of apoptosis (XIAP) siRNA
cactccagcctgggcaacagagc

SEQ ID NO: 15512 - DNA, 23 bp, Artificial Sequence
  X-linked inhibitor of apoptosis (XIAP) siRNA
actccagcctgggcaacagagca

SEQ ID NO: 15513 - DNA, 23 bp, Artificial Sequence
  X-linked inhibitor of apoptosis (XIAP) siRNA
ctccagcctgggcaacagagcaa

SEQ ID NO: 15514 - DNA, 23 bp, Artificial Sequence
  X-linked inhibitor of apoptosis (XIAP) siRNA
tccagcctgggcaacagagcaag

SEQ ID NO: 15515 - DNA, 23 bp, Artificial Sequence
  X-linked inhibitor of apoptosis (XIAP) siRNA
ccagcctgggcaacagagcaaga

SEQ ID NO: 15516 - DNA, 23 bp, Artificial Sequence
  X-linked inhibitor of apoptosis (XIAP) siRNA
cagcctgggcaacagagcaagac

SEQ ID NO: 15517 - DNA, 23 bp, Artificial Sequence
  X-linked inhibitor of apoptosis (XIAP) siRNA
agcctgggcaacagagcaagact

SEQ ID NO: 15518 - DNA, 23 bp, Artificial Sequence
  X-linked inhibitor of apoptosis (XIAP) siRNA
gcctgggcaacagagcaagactc

SEQ ID NO: 15519 - DNA, 23 bp, Artificial Sequence
  X-linked inhibitor of apoptosis (XIAP) siRNA
cctgggcaacagagcaagactct

SEQ ID NO: 15520 - DNA, 23 bp, Artificial Sequence
  X-linked inhibitor of apoptosis (XIAP) siRNA
ctgggcaacagagcaagactctg

SEQ ID NO: 15521 - DNA, 23 bp, Artificial Sequence
  X-linked inhibitor of apoptosis (XIAP) siRNA
tgggcaacagagcaagactctgt

SEQ ID NO: 15522 - DNA, 23 bp, Artificial Sequence
  X-linked inhibitor of apoptosis (XIAP) siRNA
gggcaacagagcaagactctgtc

SEQ ID NO: 15523 - DNA, 23 bp, Artificial Sequence
  X-linked inhibitor of apoptosis (XIAP) siRNA
ggcaacagagcaagactctgtct

SEQ ID NO: 15524 - DNA, 23 bp, Artificial Sequence
  X-linked inhibitor of apoptosis (XIAP) siRNA
gcaacagagcaagactctgtctc

SEQ ID NO: 15525 - DNA, 23 bp, Artificial Sequence
  X-linked inhibitor of apoptosis (XIAP) siRNA
caacagagcaagactctgtctca

SEQ ID NO: 15526 - DNA, 23 bp, Artificial Sequence
  X-linked inhibitor of apoptosis (XIAP) siRNA
aacagagcaagactctgtctcaa

SEQ ID NO: 15527 - DNA, 23 bp, Artificial Sequence
  X-linked inhibitor of apoptosis (XIAP) siRNA
acagagcaagactctgtctcaaa

SEQ ID NO: 15528 - DNA, 23 bp, Artificial Sequence
  X-linked inhibitor of apoptosis (XIAP) siRNA
cagagcaagactctgtctcaaaa

SEQ ID NO: 15529 - DNA, 23 bp, Artificial Sequence
  X-linked inhibitor of apoptosis (XIAP) siRNA
agagcaagactctgtctcaaaaa

SEQ ID NO: 15530 - DNA, 23 bp, Artificial Sequence
  X-linked inhibitor of apoptosis (XIAP) siRNA
gagcaagactctgtctcaaaaaa

SEQ ID NO: 15531 - DNA, 23 bp, Artificial Sequence
  X-linked inhibitor of apoptosis (XIAP) siRNA
agcaagactctgtctcaaaaaaa

SEQ ID NO: 15532 - DNA, 23 bp, Artificial Sequence
  X-linked inhibitor of apoptosis (XIAP) siRNA
gcaagactctgtctcaaaaaaaa

SEQ ID NO: 15533 - DNA, 23 bp, Artificial Sequence
  X-linked inhibitor of apoptosis (XIAP) siRNA
aaaaaaaagaaataagaaaatgg

SEQ ID NO: 15534 - DNA, 23 bp, Artificial Sequence
  X-linked inhibitor of apoptosis (XIAP) siRNA
aaaaaaagaaataagaaaatggg

SEQ ID NO: 15535 - DNA, 23 bp, Artificial Sequence
  X-linked inhibitor of apoptosis (XIAP) siRNA
aaaaaagaaataagaaaatggga

SEQ ID NO: 15536 - DNA, 23 bp, Artificial Sequence
  X-linked inhibitor of apoptosis (XIAP) siRNA
aaaaagaaataagaaaatgggaa

SEQ ID NO: 15537 - DNA, 23 bp, Artificial Sequence
  X-linked inhibitor of apoptosis (XIAP) siRNA
aaaagaaataagaaaatgggaag

SEQ ID NO: 15538 - DNA, 23 bp, Artificial Sequence
  X-linked inhibitor of apoptosis (XIAP) siRNA
aaagaaataagaaaatgggaagc

SEQ ID NO: 15539 - DNA, 23 bp, Artificial Sequence
  X-linked inhibitor of apoptosis (XIAP) siRNA
aagaaataagaaaatgggaagca

SEQ ID NO: 15540 - DNA, 23 bp, Artificial Sequence
  X-linked inhibitor of apoptosis (XIAP) siRNA
agaaataagaaaatgggaagcaa

SEQ ID NO: 15541 - DNA, 23 bp, Artificial Sequence
  X-linked inhibitor of apoptosis (XIAP) siRNA
gaaataagaaaatgggaagcaat

SEQ ID NO: 15542 - DNA, 23 bp, Artificial Sequence
  X-linked inhibitor of apoptosis (XIAP) siRNA
aaataagaaaatgggaagcaata

SEQ ID NO: 15543 - DNA, 23 bp, Artificial Sequence
  X-linked inhibitor of apoptosis (XIAP) siRNA
aataagaaaatgggaagcaatat

SEQ ID NO: 15544 - DNA, 23 bp, Artificial Sequence
  X-linked inhibitor of apoptosis (XIAP) siRNA
ataagaaaatgggaagcaatatt

SEQ ID NO: 15545 - DNA, 23 bp, Artificial Sequence
  X-linked inhibitor of apoptosis (XIAP) siRNA
taagaaaatgggaagcaatattt

SEQ ID NO: 15546 - DNA, 23 bp, Artificial Sequence
  X-linked inhibitor of apoptosis (XIAP) siRNA
aagaaaatgggaagcaatatttg

SEQ ID NO: 15547 - DNA, 23 bp, Artificial Sequence
  X-linked inhibitor of apoptosis (XIAP) siRNA
agaaaatgggaagcaatatttga

SEQ ID NO: 15548 - DNA, 23 bp, Artificial Sequence
  X-linked inhibitor of apoptosis (XIAP) siRNA
gaaaatgggaagcaatatttgac

SEQ ID NO: 15549 - DNA, 23 bp, Artificial Sequence
  X-linked inhibitor of apoptosis (XIAP) siRNA
aaaatgggaagcaatatttgaca

SEQ ID NO: 15550 - DNA, 23 bp, Artificial Sequence
  X-linked inhibitor of apoptosis (XIAP) siRNA
aaatgggaagcaatatttgacat

SEQ ID NO: 15551 - DNA, 23 bp, Artificial Sequence
  X-linked inhibitor of apoptosis (XIAP) siRNA
aatgggaagcaatatttgacata

SEQ ID NO: 15552 - DNA, 23 bp, Artificial Sequence
  X-linked inhibitor of apoptosis (XIAP) siRNA
atgggaagcaatatttgacatag

SEQ ID NO: 15553 - DNA, 23 bp, Artificial Sequence
  X-linked inhibitor of apoptosis (XIAP) siRNA
tgggaagcaatatttgacatagt

SEQ ID NO: 15554 - DNA, 23 bp, Artificial Sequence
  X-linked inhibitor of apoptosis (XIAP) siRNA
gggaagcaatatttgacatagtt

SEQ ID NO: 15555 - DNA, 23 bp, Artificial Sequence
  X-linked inhibitor of apoptosis (XIAP) siRNA
ggaagcaatatttgacatagttc

SEQ ID NO: 15556 - DNA, 23 bp, Artificial Sequence
  X-linked inhibitor of apoptosis (XIAP) siRNA
gaagcaatatttgacatagttct

SEQ ID NO: 15557 - DNA, 23 bp, Artificial Sequence
  X-linked inhibitor of apoptosis (XIAP) siRNA
aagcaatatttgacatagttctt

SEQ ID NO: 15558 - DNA, 23 bp, Artificial Sequence
  X-linked inhibitor of apoptosis (XIAP) siRNA
agcaatatttgacatagttcttt

SEQ ID NO: 15559 - DNA, 23 bp, Artificial Sequence
  X-linked inhibitor of apoptosis (XIAP) siRNA
gcaatatttgacatagttctttt

SEQ ID NO: 15560 - DNA, 23 bp, Artificial Sequence
  X-linked inhibitor of apoptosis (XIAP) siRNA
caatatttgacatagttcttttt

SEQ ID NO: 15561 - DNA, 23 bp, Artificial Sequence
  X-linked inhibitor of apoptosis (XIAP) siRNA
aatatttgacatagttcttttta

SEQ ID NO: 15562 - DNA, 23 bp, Artificial Sequence
  X-linked inhibitor of apoptosis (XIAP) siRNA
atatttgacatagttctttttag

SEQ ID NO: 15563 - DNA, 23 bp, Artificial Sequence
  X-linked inhibitor of apoptosis (XIAP) siRNA
tatttgacatagttctttttagt

SEQ ID NO: 15564 - DNA, 23 bp, Artificial Sequence
  X-linked inhibitor of apoptosis (XIAP) siRNA
atttgacatagttctttttagtc

SEQ ID NO: 15565 - DNA, 23 bp, Artificial Sequence
  X-linked inhibitor of apoptosis (XIAP) siRNA
tttgacatagttctttttagtca

SEQ ID NO: 15566 - DNA, 23 bp, Artificial Sequence
  X-linked inhibitor of apoptosis (XIAP) siRNA
ttgacatagttctttttagtcaa

SEQ ID NO: 15567 - DNA, 23 bp, Artificial Sequence
  X-linked inhibitor of apoptosis (XIAP) siRNA
tgacatagttctttttagtcaaa

SEQ ID NO: 15568 - DNA, 23 bp, Artificial Sequence
  X-linked inhibitor of apoptosis (XIAP) siRNA
gacatagttctttttagtcaaat

SEQ ID NO: 15569 - DNA, 23 bp, Artificial Sequence
  X-linked inhibitor of apoptosis (XIAP) siRNA
acatagttctttttagtcaaatc

SEQ ID NO: 15570 - DNA, 23 bp, Artificial Sequence
  X-linked inhibitor of apoptosis (XIAP) siRNA
catagttctttttagtcaaatct

SEQ ID NO: 15571 - DNA, 23 bp, Artificial Sequence
  X-linked inhibitor of apoptosis (XIAP) siRNA
atagttctttttagtcaaatcta

SEQ ID NO: 15572 - DNA, 23 bp, Artificial Sequence
  X-linked inhibitor of apoptosis (XIAP) siRNA
tagttctttttagtcaaatctac

SEQ ID NO: 15573 - DNA, 23 bp, Artificial Sequence
  X-linked inhibitor of apoptosis (XIAP) siRNA
agttctttttagtcaaatctact

SEQ ID NO: 15574 - DNA, 23 bp, Artificial Sequence
  X-linked inhibitor of apoptosis (XIAP) siRNA
gttctttttagtcaaatctactt

SEQ ID NO: 15575 - DNA, 23 bp, Artificial Sequence
  X-linked inhibitor of apoptosis (XIAP) siRNA
ttctttttagtcaaatctacttg

SEQ ID NO: 15576 - DNA, 23 bp, Artificial Sequence
  X-linked inhibitor of apoptosis (XIAP) siRNA
tctttttagtcaaatctacttgt

SEQ ID NO: 15577 - DNA, 23 bp, Artificial Sequence
  X-linked inhibitor of apoptosis (XIAP) siRNA
ctttttagtcaaatctacttgtt

SEQ ID NO: 15578 - DNA, 23 bp, Artificial Sequence
  X-linked inhibitor of apoptosis (XIAP) siRNA
tttttagtcaaatctacttgtta

SEQ ID NO: 15579 - DNA, 23 bp, Artificial Sequence
  X-linked inhibitor of apoptosis (XIAP) siRNA
ttttagtcaaatctacttgttaa

SEQ ID NO: 15580 - DNA, 23 bp, Artificial Sequence
  X-linked inhibitor of apoptosis (XIAP) siRNA
tttagtcaaatctacttgttaaa

SEQ ID NO: 15581 - DNA, 23 bp, Artificial Sequence
  X-linked inhibitor of apoptosis (XIAP) siRNA
ttagtcaaatctacttgttaaaa

SEQ ID NO: 15582 - DNA, 23 bp, Artificial Sequence
  X-linked inhibitor of apoptosis (XIAP) siRNA
tagtcaaatctacttgttaaaaa

SEQ ID NO: 15583 - DNA, 23 bp, Artificial Sequence
  X-linked inhibitor of apoptosis (XIAP) siRNA
agtcaaatctacttgttaaaaaa

SEQ ID NO: 15584 - DNA, 23 bp, Artificial Sequence
  X-linked inhibitor of apoptosis (XIAP) siRNA
gtcaaatctacttgttaaaaaaa

SEQ ID NO: 15585 - DNA, 23 bp, Artificial Sequence
  X-linked inhibitor of apoptosis (XIAP) siRNA
tcaaatctacttgttaaaaaaag

SEQ ID NO: 15586 - DNA, 23 bp, Artificial Sequence
  X-linked inhibitor of apoptosis (XIAP) siRNA
caaatctacttgttaaaaaaagg

SEQ ID NO: 15587 - DNA, 23 bp, Artificial Sequence
  X-linked inhibitor of apoptosis (XIAP) siRNA
aaatctacttgttaaaaaaaggg

SEQ ID NO: 15588 - DNA, 23 bp, Artificial Sequence
  X-linked inhibitor of apoptosis (XIAP) siRNA
aatctacttgttaaaaaaagggt

SEQ ID NO: 15589 - DNA, 23 bp, Artificial Sequence
  X-linked inhibitor of apoptosis (XIAP) siRNA
atctacttgttaaaaaaagggta

SEQ ID NO: 15590 - DNA, 23 bp, Artificial Sequence
  X-linked inhibitor of apoptosis (XIAP) siRNA
tctacttgttaaaaaaagggtag

SEQ ID NO: 15591 - DNA, 23 bp, Artificial Sequence
  X-linked inhibitor of apoptosis (XIAP) siRNA
ctacttgttaaaaaaagggtagc

SEQ ID NO: 15592 - DNA, 23 bp, Artificial Sequence
  X-linked inhibitor of apoptosis (XIAP) siRNA
tacttgttaaaaaaagggtagca

SEQ ID NO: 15593 - DNA, 23 bp, Artificial Sequence
  X-linked inhibitor of apoptosis (XIAP) siRNA
acttgttaaaaaaagggtagcag

SEQ ID NO: 15594 - DNA, 23 bp, Artificial Sequence
  X-linked inhibitor of apoptosis (XIAP) siRNA
cttgttaaaaaaagggtagcagt

SEQ ID NO: 15595 - DNA, 23 bp, Artificial Sequence
  X-linked inhibitor of apoptosis (XIAP) siRNA
ttgttaaaaaaagggtagcagtt

SEQ ID NO: 15596 - DNA, 23 bp, Artificial Sequence
  X-linked inhibitor of apoptosis (XIAP) siRNA
tgttaaaaaaagggtagcagttt

SEQ ID NO: 15597 - DNA, 23 bp, Artificial Sequence
  X-linked inhibitor of apoptosis (XIAP) siRNA
gttaaaaaaagggtagcagttta

SEQ ID NO: 15598 - DNA, 23 bp, Artificial Sequence
  X-linked inhibitor of apoptosis (XIAP) siRNA
ttaaaaaaagggtagcagtttat

SEQ ID NO: 15599 - DNA, 23 bp, Artificial Sequence
  X-linked inhibitor of apoptosis (XIAP) siRNA
taaaaaaagggtagcagtttatt

SEQ ID NO: 15600 - DNA, 23 bp, Artificial Sequence
  X-linked inhibitor of apoptosis (XIAP) siRNA
aaaaaaagggtagcagtttattc

SEQ ID NO: 15601 - DNA, 23 bp, Artificial Sequence
  X-linked inhibitor of apoptosis (XIAP) siRNA
aaaaaagggtagcagtttattca

SEQ ID NO: 15602 - DNA, 23 bp, Artificial Sequence
  X-linked inhibitor of apoptosis (XIAP) siRNA
aaaaagggtagcagtttattcat

SEQ ID NO: 15603 - DNA, 23 bp, Artificial Sequence
  X-linked inhibitor of apoptosis (XIAP) siRNA
aaaagggtagcagtttattcatc

SEQ ID NO: 15604 - DNA, 23 bp, Artificial Sequence
  X-linked inhibitor of apoptosis (XIAP) siRNA
aaagggtagcagtttattcatct

SEQ ID NO: 15605 - DNA, 23 bp, Artificial Sequence
  X-linked inhibitor of apoptosis (XIAP) siRNA
aagggtagcagtttattcatctg

SEQ ID NO: 15606 - DNA, 23 bp, Artificial Sequence
  X-linked inhibitor of apoptosis (XIAP) siRNA
agggtagcagtttattcatctgt

SEQ ID NO: 15607 - DNA, 23 bp, Artificial Sequence
  X-linked inhibitor of apoptosis (XIAP) siRNA
gggtagcagtttattcatctgtg

SEQ ID NO: 15608 - DNA, 23 bp, Artificial Sequence
  X-linked inhibitor of apoptosis (XIAP) siRNA
ggtagcagtttattcatctgtga

SEQ ID NO: 15609 - DNA, 23 bp, Artificial Sequence
  X-linked inhibitor of apoptosis (XIAP) siRNA
gtagcagtttattcatctgtgaa

SEQ ID NO: 15610 - DNA, 23 bp, Artificial Sequence
  X-linked inhibitor of apoptosis (XIAP) siRNA
tagcagtttattcatctgtgaaa

SEQ ID NO: 15611 - DNA, 23 bp, Artificial Sequence
  X-linked inhibitor of apoptosis (XIAP) siRNA
agcagtttattcatctgtgaaag

SEQ ID NO: 15612 - DNA, 23 bp, Artificial Sequence
  X-linked inhibitor of apoptosis (XIAP) siRNA
gcagtttattcatctgtgaaagg

SEQ ID NO: 15613 - DNA, 23 bp, Artificial Sequence
  X-linked inhibitor of apoptosis (XIAP) siRNA
cagtttattcatctgtgaaagga

SEQ ID NO: 15614 - DNA, 23 bp, Artificial Sequence
  X-linked inhibitor of apoptosis (XIAP) siRNA
agtttattcatctgtgaaaggaa

SEQ ID NO: 15615 - DNA, 23 bp, Artificial Sequence
  X-linked inhibitor of apoptosis (XIAP) siRNA
gtttattcatctgtgaaaggaaa

SEQ ID NO: 15616 - DNA, 23 bp, Artificial Sequence
  X-linked inhibitor of apoptosis (XIAP) siRNA
tttattcatctgtgaaaggaaaa

SEQ ID NO: 15617 - DNA, 23 bp, Artificial Sequence
  X-linked inhibitor of apoptosis (XIAP) siRNA
ttattcatctgtgaaaggaaaat

SEQ ID NO: 15618 - DNA, 23 bp, Artificial Sequence
  X-linked inhibitor of apoptosis (XIAP) siRNA
tattcatctgtgaaaggaaaata

SEQ ID NO: 15619 - DNA, 23 bp, Artificial Sequence
  X-linked inhibitor of apoptosis (XIAP) siRNA
attcatctgtgaaaggaaaataa

SEQ ID NO: 15620 - DNA, 23 bp, Artificial Sequence
  X-linked inhibitor of apoptosis (XIAP) siRNA
ttcatctgtgaaaggaaaataat

SEQ ID NO: 15621 - DNA, 23 bp, Artificial Sequence
  X-linked inhibitor of apoptosis (XIAP) siRNA
tcatctgtgaaaggaaaataata

SEQ ID NO: 15622 - DNA, 23 bp, Artificial Sequence
  X-linked inhibitor of apoptosis (XIAP) siRNA
catctgtgaaaggaaaataatac

SEQ ID NO: 15623 - DNA, 23 bp, Artificial Sequence
  X-linked inhibitor of apoptosis (XIAP) siRNA
atctgtgaaaggaaaataatact

SEQ ID NO: 15624 - DNA, 23 bp, Artificial Sequence
  X-linked inhibitor of apoptosis (XIAP) siRNA
tctgtgaaaggaaaataatactt

SEQ ID NO: 15625 - DNA, 23 bp, Artificial Sequence
  X-linked inhibitor of apoptosis (XIAP) siRNA
ctgtgaaaggaaaataatactta

SEQ ID NO: 15626 - DNA, 23 bp, Artificial Sequence
  X-linked inhibitor of apoptosis (XIAP) siRNA
tgtgaaaggaaaataatacttat

SEQ ID NO: 15627 - DNA, 23 bp, Artificial Sequence
  X-linked inhibitor of apoptosis (XIAP) siRNA
gtgaaaggaaaataatacttatc

SEQ ID NO: 15628 - DNA, 23 bp, Artificial Sequence
  X-linked inhibitor of apoptosis (XIAP) siRNA
tgaaaggaaaataatacttatct

SEQ ID NO: 15629 - DNA, 23 bp, Artificial Sequence
  X-linked inhibitor of apoptosis (XIAP) siRNA
gaaaggaaaataatacttatctt

SEQ ID NO: 15630 - DNA, 23 bp, Artificial Sequence
  X-linked inhibitor of apoptosis (XIAP) siRNA
aaaggaaaataatacttatctta

SEQ ID NO: 15631 - DNA, 23 bp, Artificial Sequence
  X-linked inhibitor of apoptosis (XIAP) siRNA
aaggaaaataatacttatcttac

SEQ ID NO: 15632 - DNA, 23 bp, Artificial Sequence
  X-linked inhibitor of apoptosis (XIAP) siRNA
aggaaaataatacttatcttaca

SEQ ID NO: 15633 - DNA, 23 bp, Artificial Sequence
  X-linked inhibitor of apoptosis (XIAP) siRNA
ggaaaataatacttatcttacaa

SEQ ID NO: 15634 - DNA, 23 bp, Artificial Sequence
  X-linked inhibitor of apoptosis (XIAP) siRNA
gaaaataatacttatcttacaag

SEQ ID NO: 15635 - DNA, 23 bp, Artificial Sequence
  X-linked inhibitor of apoptosis (XIAP) siRNA
aaaataatacttatcttacaagg

SEQ ID NO: 15636 - DNA, 23 bp, Artificial Sequence
  X-linked inhibitor of apoptosis (XIAP) siRNA
aaataatacttatcttacaaggt

SEQ ID NO: 15637 - DNA, 23 bp, Artificial Sequence
  X-linked inhibitor of apoptosis (XIAP) siRNA
aataatacttatcttacaaggtt

SEQ ID NO: 15638 - DNA, 23 bp, Artificial Sequence
  X-linked inhibitor of apoptosis (XIAP) siRNA
ataatacttatcttacaaggttg

SEQ ID NO: 15639 - DNA, 23 bp, Artificial Sequence
  X-linked inhibitor of apoptosis (XIAP) siRNA
taatacttatcttacaaggttgc

SEQ ID NO: 15640 - DNA, 23 bp, Artificial Sequence
  X-linked inhibitor of apoptosis (XIAP) siRNA
aatacttatcttacaaggttgca

SEQ ID NO: 15641 - DNA, 23 bp, Artificial Sequence
  X-linked inhibitor of apoptosis (XIAP) siRNA
atacttatcttacaaggttgcaa

SEQ ID NO: 15642 - DNA, 23 bp, Artificial Sequence
  X-linked inhibitor of apoptosis (XIAP) siRNA
tacttatcttacaaggttgcaag

SEQ ID NO: 15643 - DNA, 23 bp, Artificial Sequence
  X-linked inhibitor of apoptosis (XIAP) siRNA
acttatcttacaaggttgcaaga

SEQ ID NO: 15644 - DNA, 23 bp, Artificial Sequence
  X-linked inhibitor of apoptosis (XIAP) siRNA
cttatcttacaaggttgcaagag

SEQ ID NO: 15645 - DNA, 23 bp, Artificial Sequence
  X-linked inhibitor of apoptosis (XIAP) siRNA
ttatcttacaaggttgcaagagc

SEQ ID NO: 15646 - DNA, 23 bp, Artificial Sequence
  X-linked inhibitor of apoptosis (XIAP) siRNA
tatcttacaaggttgcaagagct

SEQ ID NO: 15647 - DNA, 23 bp, Artificial Sequence
  X-linked inhibitor of apoptosis (XIAP) siRNA
atcttacaaggttgcaagagctc

SEQ ID NO: 15648 - DNA, 23 bp, Artificial Sequence
  X-linked inhibitor of apoptosis (XIAP) siRNA
tcttacaaggttgcaagagctca

SEQ ID NO: 15649 - DNA, 23 bp, Artificial Sequence
  X-linked inhibitor of apoptosis (XIAP) siRNA
cttacaaggttgcaagagctcaa

SEQ ID NO: 15650 - DNA, 23 bp, Artificial Sequence
  X-linked inhibitor of apoptosis (XIAP) siRNA
ttacaaggttgcaagagctcaag

SEQ ID NO: 15651 - DNA, 23 bp, Artificial Sequence
  X-linked inhibitor of apoptosis (XIAP) siRNA
tacaaggttgcaagagctcaagg

SEQ ID NO: 15652 - DNA, 23 bp, Artificial Sequence
  X-linked inhibitor of apoptosis (XIAP) siRNA
acaaggttgcaagagctcaagga

SEQ ID NO: 15653 - DNA, 23 bp, Artificial Sequence
  X-linked inhibitor of apoptosis (XIAP) siRNA
caaggttgcaagagctcaaggag

SEQ ID NO: 15654 - DNA, 23 bp, Artificial Sequence
  X-linked inhibitor of apoptosis (XIAP) siRNA
aaggttgcaagagctcaaggaga

SEQ ID NO: 15655 - DNA, 23 bp, Artificial Sequence
  X-linked inhibitor of apoptosis (XIAP) siRNA
aggttgcaagagctcaaggagac

SEQ ID NO: 15656 - DNA, 23 bp, Artificial Sequence
  X-linked inhibitor of apoptosis (XIAP) siRNA
ggttgcaagagctcaaggagacc

SEQ ID NO: 15657 - DNA, 23 bp, Artificial Sequence
  X-linked inhibitor of apoptosis (XIAP) siRNA
gttgcaagagctcaaggagacca

SEQ ID NO: 15658 - DNA, 23 bp, Artificial Sequence
  X-linked inhibitor of apoptosis (XIAP) siRNA
ttgcaagagctcaaggagaccat

SEQ ID NO: 15659 - DNA, 23 bp, Artificial Sequence
  X-linked inhibitor of apoptosis (XIAP) siRNA
tgcaagagctcaaggagaccatg

SEQ ID NO: 15660 - DNA, 23 bp, Artificial Sequence
  X-linked inhibitor of apoptosis (XIAP) siRNA
gcaagagctcaaggagaccatgt

SEQ ID NO: 15661 - DNA, 23 bp, Artificial Sequence
  X-linked inhibitor of apoptosis (XIAP) siRNA
caagagctcaaggagaccatgta

SEQ ID NO: 15662 - DNA, 23 bp, Artificial Sequence
  X-linked inhibitor of apoptosis (XIAP) siRNA
aagagctcaaggagaccatgtat

SEQ ID NO: 15663 - DNA, 23 bp, Artificial Sequence
  X-linked inhibitor of apoptosis (XIAP) siRNA
agagctcaaggagaccatgtatg

SEQ ID NO: 15664 - DNA, 23 bp, Artificial Sequence
  X-linked inhibitor of apoptosis (XIAP) siRNA
gagctcaaggagaccatgtatgt

SEQ ID NO: 15665 - DNA, 23 bp, Artificial Sequence
  X-linked inhibitor of apoptosis (XIAP) siRNA
agctcaaggagaccatgtatgta

SEQ ID NO: 15666 - DNA, 23 bp, Artificial Sequence
  X-linked inhibitor of apoptosis (XIAP) siRNA
gctcaaggagaccatgtatgtaa

SEQ ID NO: 15667 - DNA, 23 bp, Artificial Sequence
  X-linked inhibitor of apoptosis (XIAP) siRNA
ctcaaggagaccatgtatgtaaa

SEQ ID NO: 15668 - DNA, 23 bp, Artificial Sequence
  X-linked inhibitor of apoptosis (XIAP) siRNA
tcaaggagaccatgtatgtaaag

SEQ ID NO: 15669 - DNA, 23 bp, Artificial Sequence
  X-linked inhibitor of apoptosis (XIAP) siRNA
caaggagaccatgtatgtaaagt

SEQ ID NO: 15670 - DNA, 23 bp, Artificial Sequence
  X-linked inhibitor of apoptosis (XIAP) siRNA
aaggagaccatgtatgtaaagtt

SEQ ID NO: 15671 - DNA, 23 bp, Artificial Sequence
  X-linked inhibitor of apoptosis (XIAP) siRNA
aggagaccatgtatgtaaagttc

SEQ ID NO: 15672 - DNA, 23 bp, Artificial Sequence
  X-linked inhibitor of apoptosis (XIAP) siRNA
ggagaccatgtatgtaaagttcc

SEQ ID NO: 15673 - DNA, 23 bp, Artificial Sequence
  X-linked inhibitor of apoptosis (XIAP) siRNA
gagaccatgtatgtaaagttcct

SEQ ID NO: 15674 - DNA, 23 bp, Artificial Sequence
  X-linked inhibitor of apoptosis (XIAP) siRNA
agaccatgtatgtaaagttcctg

SEQ ID NO: 15675 - DNA, 23 bp, Artificial Sequence
  X-linked inhibitor of apoptosis (XIAP) siRNA
gaccatgtatgtaaagttcctgc

SEQ ID NO: 15676 - DNA, 23 bp, Artificial Sequence
  X-linked inhibitor of apoptosis (XIAP) siRNA
accatgtatgtaaagttcctgct

SEQ ID NO: 15677 - DNA, 23 bp, Artificial Sequence
  X-linked inhibitor of apoptosis (XIAP) siRNA
ccatgtatgtaaagttcctgctg

SEQ ID NO: 15678 - DNA, 23 bp, Artificial Sequence
  X-linked inhibitor of apoptosis (XIAP) siRNA
catgtatgtaaagttcctgctgt

SEQ ID NO: 15679 - DNA, 23 bp, Artificial Sequence
  X-linked inhibitor of apoptosis (XIAP) siRNA
atgtatgtaaagttcctgctgta

SEQ ID NO: 15680 - DNA, 23 bp, Artificial Sequence
  X-linked inhibitor of apoptosis (XIAP) siRNA
tgtatgtaaagttcctgctgtaa

SEQ ID NO: 15681 - DNA, 23 bp, Artificial Sequence
  X-linked inhibitor of apoptosis (XIAP) siRNA
gtatgtaaagttcctgctgtaaa

SEQ ID NO: 15682 - DNA, 23 bp, Artificial Sequence
  X-linked inhibitor of apoptosis (XIAP) siRNA
tatgtaaagttcctgctgtaaat

SEQ ID NO: 15683 - DNA, 23 bp, Artificial Sequence
  X-linked inhibitor of apoptosis (XIAP) siRNA
atgtaaagttcctgctgtaaata

SEQ ID NO: 15684 - DNA, 23 bp, Artificial Sequence
  X-linked inhibitor of apoptosis (XIAP) siRNA
tgtaaagttcctgctgtaaatat

SEQ ID NO: 15685 - DNA, 23 bp, Artificial Sequence
  X-linked inhibitor of apoptosis (XIAP) siRNA
gtaaagttcctgctgtaaatatg

SEQ ID NO: 15686 - DNA, 23 bp, Artificial Sequence
  X-linked inhibitor of apoptosis (XIAP) siRNA
taaagttcctgctgtaaatatga

SEQ ID NO: 15687 - DNA, 23 bp, Artificial Sequence
  X-linked inhibitor of apoptosis (XIAP) siRNA
aaagttcctgctgtaaatatgaa

SEQ ID NO: 15688 - DNA, 23 bp, Artificial Sequence
  X-linked inhibitor of apoptosis (XIAP) siRNA
aagttcctgctgtaaatatgaac

SEQ ID NO: 15689 - DNA, 23 bp, Artificial Sequence
  X-linked inhibitor of apoptosis (XIAP) siRNA
agttcctgctgtaaatatgaact

SEQ ID NO: 15690 - DNA, 23 bp, Artificial Sequence
  X-linked inhibitor of apoptosis (XIAP) siRNA
gttcctgctgtaaatatgaactc

SEQ ID NO: 15691 - DNA, 23 bp, Artificial Sequence
  X-linked inhibitor of apoptosis (XIAP) siRNA
ttcctgctgtaaatatgaactcc

SEQ ID NO: 15692 - DNA, 23 bp, Artificial Sequence
  X-linked inhibitor of apoptosis (XIAP) siRNA
tcctgctgtaaatatgaactccc

SEQ ID NO: 15693 - DNA, 23 bp, Artificial Sequence
  X-linked inhibitor of apoptosis (XIAP) siRNA
cctgctgtaaatatgaactccca

SEQ ID NO: 15694 - DNA, 23 bp, Artificial Sequence
  X-linked inhibitor of apoptosis (XIAP) siRNA
ctgctgtaaatatgaactcccat

SEQ ID NO: 15695 - DNA, 23 bp, Artificial Sequence
  X-linked inhibitor of apoptosis (XIAP) siRNA
tgctgtaaatatgaactcccatc

SEQ ID NO: 15696 - DNA, 23 bp, Artificial Sequence
  X-linked inhibitor of apoptosis (XIAP) siRNA
gctgtaaatatgaactcccatcc

SEQ ID NO: 15697 - DNA, 23 bp, Artificial Sequence
  X-linked inhibitor of apoptosis (XIAP) siRNA
ctgtaaatatgaactcccatcct

SEQ ID NO: 15698 - DNA, 23 bp, Artificial Sequence
  X-linked inhibitor of apoptosis (XIAP) siRNA
tgtaaatatgaactcccatccta

SEQ ID NO: 15699 - DNA, 23 bp, Artificial Sequence
  X-linked inhibitor of apoptosis (XIAP) siRNA
gtaaatatgaactcccatcctaa

SEQ ID NO: 15700 - DNA, 23 bp, Artificial Sequence
  X-linked inhibitor of apoptosis (XIAP) siRNA
taaatatgaactcccatcctaat

SEQ ID NO: 15701 - DNA, 23 bp, Artificial Sequence
  X-linked inhibitor of apoptosis (XIAP) siRNA
aaatatgaactcccatcctaata

SEQ ID NO: 15702 - DNA, 23 bp, Artificial Sequence
  X-linked inhibitor of apoptosis (XIAP) siRNA
aatatgaactcccatcctaatac

SEQ ID NO: 15703 - DNA, 23 bp, Artificial Sequence
  X-linked inhibitor of apoptosis (XIAP) siRNA
atatgaactcccatcctaatacc

SEQ ID NO: 15704 - DNA, 23 bp, Artificial Sequence
  X-linked inhibitor of apoptosis (XIAP) siRNA
tatgaactcccatcctaataccc

SEQ ID NO: 15705 - DNA, 23 bp, Artificial Sequence
  X-linked inhibitor of apoptosis (XIAP) siRNA
atgaactcccatcctaataccct

SEQ ID NO: 15706 - DNA, 23 bp, Artificial Sequence
  X-linked inhibitor of apoptosis (XIAP) siRNA
tgaactcccatcctaataccctt

SEQ ID NO: 15707 - DNA, 23 bp, Artificial Sequence
  X-linked inhibitor of apoptosis (XIAP) siRNA
gaactcccatcctaatacccttt

SEQ ID NO: 15708 - DNA, 23 bp, Artificial Sequence
  X-linked inhibitor of apoptosis (XIAP) siRNA
aactcccatcctaataccctttt

SEQ ID NO: 15709 - DNA, 23 bp, Artificial Sequence
  X-linked inhibitor of apoptosis (XIAP) siRNA
actcccatcctaataccctttta

SEQ ID NO: 15710 - DNA, 23 bp, Artificial Sequence
  X-linked inhibitor of apoptosis (XIAP) siRNA
ctcccatcctaatacccttttac

SEQ ID NO: 15711 - DNA, 23 bp, Artificial Sequence
  X-linked inhibitor of apoptosis (XIAP) siRNA
tcccatcctaatacccttttacc

SEQ ID NO: 15712 - DNA, 23 bp, Artificial Sequence
  X-linked inhibitor of apoptosis (XIAP) siRNA
cccatcctaatacccttttacct

SEQ ID NO: 15713 - DNA, 23 bp, Artificial Sequence
  X-linked inhibitor of apoptosis (XIAP) siRNA
ccatcctaatacccttttacctc

SEQ ID NO: 15714 - DNA, 23 bp, Artificial Sequence
  X-linked inhibitor of apoptosis (XIAP) siRNA
catcctaatacccttttacctct

SEQ ID NO: 15715 - DNA, 23 bp, Artificial Sequence
  X-linked inhibitor of apoptosis (XIAP) siRNA
atcctaatacccttttacctctc

SEQ ID NO: 15716 - DNA, 23 bp, Artificial Sequence
  X-linked inhibitor of apoptosis (XIAP) siRNA
tcctaatacccttttacctctct

SEQ ID NO: 15717 - DNA, 23 bp, Artificial Sequence
  X-linked inhibitor of apoptosis (XIAP) siRNA
cctaatacccttttacctctctg

SEQ ID NO: 15718 - DNA, 23 bp, Artificial Sequence
  X-linked inhibitor of apoptosis (XIAP) siRNA
ctaatacccttttacctctctgt

SEQ ID NO: 15719 - DNA, 23 bp, Artificial Sequence
  X-linked inhibitor of apoptosis (XIAP) siRNA
taatacccttttacctctctgtg

SEQ ID NO: 15720 - DNA, 23 bp, Artificial Sequence
  X-linked inhibitor of apoptosis (XIAP) siRNA
aatacccttttacctctctgtgg

SEQ ID NO: 15721 - DNA, 23 bp, Artificial Sequence
  X-linked inhibitor of apoptosis (XIAP) siRNA
atacccttttacctctctgtggg

SEQ ID NO: 15722 - DNA, 23 bp, Artificial Sequence
  X-linked inhibitor of apoptosis (XIAP) siRNA
tacccttttacctctctgtgggt

SEQ ID NO: 15723 - DNA, 23 bp, Artificial Sequence
  X-linked inhibitor of apoptosis (XIAP) siRNA
acccttttacctctctgtgggtt

SEQ ID NO: 15724 - DNA, 23 bp, Artificial Sequence
  X-linked inhibitor of apoptosis (XIAP) siRNA
cccttttacctctctgtgggttt

SEQ ID NO: 15725 - DNA, 23 bp, Artificial Sequence
  X-linked inhibitor of apoptosis (XIAP) siRNA
ccttttacctctctgtgggtttg

SEQ ID NO: 15726 - DNA, 23 bp, Artificial Sequence
  X-linked inhibitor of apoptosis (XIAP) siRNA
cttttacctctctgtgggtttgt

SEQ ID NO: 15727 - DNA, 23 bp, Artificial Sequence
  X-linked inhibitor of apoptosis (XIAP) siRNA
ttttacctctctgtgggtttgtc

SEQ ID NO: 15728 - DNA, 23 bp, Artificial Sequence
  X-linked inhibitor of apoptosis (XIAP) siRNA
tttacctctctgtgggtttgtct

SEQ ID NO: 15729 - DNA, 23 bp, Artificial Sequence
  X-linked inhibitor of apoptosis (XIAP) siRNA
ttacctctctgtgggtttgtctt

SEQ ID NO: 15730 - DNA, 23 bp, Artificial Sequence
  X-linked inhibitor of apoptosis (XIAP) siRNA
tacctctctgtgggtttgtcttg

SEQ ID NO: 15731 - DNA, 23 bp, Artificial Sequence
  X-linked inhibitor of apoptosis (XIAP) siRNA
acctctctgtgggtttgtcttga

SEQ ID NO: 15732 - DNA, 23 bp, Artificial Sequence
  X-linked inhibitor of apoptosis (XIAP) siRNA
cctctctgtgggtttgtcttgac

SEQ ID NO: 15733 - DNA, 23 bp, Artificial Sequence
  X-linked inhibitor of apoptosis (XIAP) siRNA
ctctctgtgggtttgtcttgacc

SEQ ID NO: 15734 - DNA, 23 bp, Artificial Sequence
  X-linked inhibitor of apoptosis (XIAP) siRNA
tctctgtgggtttgtcttgacct

SEQ ID NO: 15735 - DNA, 23 bp, Artificial Sequence
  X-linked inhibitor of apoptosis (XIAP) siRNA
ctctgtgggtttgtcttgacctg

SEQ ID NO: 15736 - DNA, 23 bp, Artificial Sequence
  X-linked inhibitor of apoptosis (XIAP) siRNA
tctgtgggtttgtcttgacctgg

SEQ ID NO: 15737 - DNA, 23 bp, Artificial Sequence
  X-linked inhibitor of apoptosis (XIAP) siRNA
ctgtgggtttgtcttgacctgga

SEQ ID NO: 15738 - DNA, 23 bp, Artificial Sequence
  X-linked inhibitor of apoptosis (XIAP) siRNA
tgtgggtttgtcttgacctggaa

SEQ ID NO: 15739 - DNA, 23 bp, Artificial Sequence
  X-linked inhibitor of apoptosis (XIAP) siRNA
gtgggtttgtcttgacctggaaa

SEQ ID NO: 15740 - DNA, 23 bp, Artificial Sequence
  X-linked inhibitor of apoptosis (XIAP) siRNA
tgggtttgtcttgacctggaaat

SEQ ID NO: 15741 - DNA, 23 bp, Artificial Sequence
  X-linked inhibitor of apoptosis (XIAP) siRNA
gggtttgtcttgacctggaaatt

SEQ ID NO: 15742 - DNA, 23 bp, Artificial Sequence
  X-linked inhibitor of apoptosis (XIAP) siRNA
ggtttgtcttgacctggaaattt

SEQ ID NO: 15743 - DNA, 23 bp, Artificial Sequence
  X-linked inhibitor of apoptosis (XIAP) siRNA
gtttgtcttgacctggaaatttg

SEQ ID NO: 15744 - DNA, 23 bp, Artificial Sequence
  X-linked inhibitor of apoptosis (XIAP) siRNA
tttgtcttgacctggaaatttgg

SEQ ID NO: 15745 - DNA, 23 bp, Artificial Sequence
  X-linked inhibitor of apoptosis (XIAP) siRNA
ttgtcttgacctggaaatttggg

SEQ ID NO: 15746 - DNA, 23 bp, Artificial Sequence
  X-linked inhibitor of apoptosis (XIAP) siRNA
tgtcttgacctggaaatttgggc

SEQ ID NO: 15747 - DNA, 23 bp, Artificial Sequence
  X-linked inhibitor of apoptosis (XIAP) siRNA
gtcttgacctggaaatttgggct

SEQ ID NO: 15748 - DNA, 23 bp, Artificial Sequence
  X-linked inhibitor of apoptosis (XIAP) siRNA
tcttgacctggaaatttgggcta

SEQ ID NO: 15749 - DNA, 23 bp, Artificial Sequence
  X-linked inhibitor of apoptosis (XIAP) siRNA
cttgacctggaaatttgggctaa

SEQ ID NO: 15750 - DNA, 23 bp, Artificial Sequence
  X-linked inhibitor of apoptosis (XIAP) siRNA
ttgacctggaaatttgggctaaa

SEQ ID NO: 15751 - DNA, 23 bp, Artificial Sequence
  X-linked inhibitor of apoptosis (XIAP) siRNA
tgacctggaaatttgggctaaaa

SEQ ID NO: 15752 - DNA, 23 bp, Artificial Sequence
  X-linked inhibitor of apoptosis (XIAP) siRNA
gacctggaaatttgggctaaaac

SEQ ID NO: 15753 - DNA, 23 bp, Artificial Sequence
  X-linked inhibitor of apoptosis (XIAP) siRNA
acctggaaatttgggctaaaact

SEQ ID NO: 15754 - DNA, 23 bp, Artificial Sequence
  X-linked inhibitor of apoptosis (XIAP) siRNA
cctggaaatttgggctaaaactt

SEQ ID NO: 15755 - DNA, 23 bp, Artificial Sequence
  X-linked inhibitor of apoptosis (XIAP) siRNA
ctggaaatttgggctaaaactta

SEQ ID NO: 15756 - DNA, 23 bp, Artificial Sequence
  X-linked inhibitor of apoptosis (XIAP) siRNA
tggaaatttgggctaaaacttag

SEQ ID NO: 15757 - DNA, 23 bp, Artificial Sequence
  X-linked inhibitor of apoptosis (XIAP) siRNA
ggaaatttgggctaaaacttaga

SEQ ID NO: 15758 - DNA, 23 bp, Artificial Sequence
  X-linked inhibitor of apoptosis (XIAP) siRNA
gaaatttgggctaaaacttagaa

SEQ ID NO: 15759 - DNA, 23 bp, Artificial Sequence
  X-linked inhibitor of apoptosis (XIAP) siRNA
aaatttgggctaaaacttagaaa

SEQ ID NO: 15760 - DNA, 23 bp, Artificial Sequence
  X-linked inhibitor of apoptosis (XIAP) siRNA
aatttgggctaaaacttagaaaa

SEQ ID NO: 15761 - DNA, 23 bp, Artificial Sequence
  X-linked inhibitor of apoptosis (XIAP) siRNA
atttgggctaaaacttagaaaaa

SEQ ID NO: 15762 - DNA, 23 bp, Artificial Sequence
  X-linked inhibitor of apoptosis (XIAP) siRNA
tttgggctaaaacttagaaaaaa

SEQ ID NO: 15763 - DNA, 23 bp, Artificial Sequence
  X-linked inhibitor of apoptosis (XIAP) siRNA
ttgggctaaaacttagaaaaaat

SEQ ID NO: 15764 - DNA, 23 bp, Artificial Sequence
  X-linked inhibitor of apoptosis (XIAP) siRNA
tgggctaaaacttagaaaaaatt

SEQ ID NO: 15765 - DNA, 23 bp, Artificial Sequence
  X-linked inhibitor of apoptosis (XIAP) siRNA
gggctaaaacttagaaaaaattc

SEQ ID NO: 15766 - DNA, 23 bp, Artificial Sequence
  X-linked inhibitor of apoptosis (XIAP) siRNA
ggctaaaacttagaaaaaattct

SEQ ID NO: 15767 - DNA, 23 bp, Artificial Sequence
  X-linked inhibitor of apoptosis (XIAP) siRNA
gctaaaacttagaaaaaattctt

SEQ ID NO: 15768 - DNA, 23 bp, Artificial Sequence
  X-linked inhibitor of apoptosis (XIAP) siRNA
ctaaaacttagaaaaaattctta

SEQ ID NO: 15769 - DNA, 23 bp, Artificial Sequence
  X-linked inhibitor of apoptosis (XIAP) siRNA
taaaacttagaaaaaattcttac

SEQ ID NO: 15770 - DNA, 23 bp, Artificial Sequence
  X-linked inhibitor of apoptosis (XIAP) siRNA
aaaacttagaaaaaattcttaca

SEQ ID NO: 15771 - DNA, 23 bp, Artificial Sequence
  X-linked inhibitor of apoptosis (XIAP) siRNA
aaacttagaaaaaattcttacat

SEQ ID NO: 15772 - DNA, 23 bp, Artificial Sequence
  X-linked inhibitor of apoptosis (XIAP) siRNA
aacttagaaaaaattcttacatg

SEQ ID NO: 15773 - DNA, 23 bp, Artificial Sequence
  X-linked inhibitor of apoptosis (XIAP) siRNA
acttagaaaaaattcttacatga

SEQ ID NO: 15774 - DNA, 23 bp, Artificial Sequence
  X-linked inhibitor of apoptosis (XIAP) siRNA
cttagaaaaaattcttacatgat

SEQ ID NO: 15775 - DNA, 23 bp, Artificial Sequence
  X-linked inhibitor of apoptosis (XIAP) siRNA
ttagaaaaaattcttacatgata

SEQ ID NO: 15776 - DNA, 23 bp, Artificial Sequence
  X-linked inhibitor of apoptosis (XIAP) siRNA
tagaaaaaattcttacatgataa

SEQ ID NO: 15777 - DNA, 23 bp, Artificial Sequence
  X-linked inhibitor of apoptosis (XIAP) siRNA
agaaaaaattcttacatgataac

SEQ ID NO: 15778 - DNA, 23 bp, Artificial Sequence
  X-linked inhibitor of apoptosis (XIAP) siRNA
gaaaaaattcttacatgataact

SEQ ID NO: 15779 - DNA, 23 bp, Artificial Sequence
  X-linked inhibitor of apoptosis (XIAP) siRNA
aaaaaattcttacatgataactc

SEQ ID NO: 15780 - DNA, 23 bp, Artificial Sequence
  X-linked inhibitor of apoptosis (XIAP) siRNA
aaaaattcttacatgataactca

SEQ ID NO: 15781 - DNA, 23 bp, Artificial Sequence
  X-linked inhibitor of apoptosis (XIAP) siRNA
aaaattcttacatgataactcag

SEQ ID NO: 15782 - DNA, 23 bp, Artificial Sequence
  X-linked inhibitor of apoptosis (XIAP) siRNA
aaattcttacatgataactcagt

SEQ ID NO: 15783 - DNA, 23 bp, Artificial Sequence
  X-linked inhibitor of apoptosis (XIAP) siRNA
aattcttacatgataactcagtg

SEQ ID NO: 15784 - DNA, 23 bp, Artificial Sequence
  X-linked inhibitor of apoptosis (XIAP) siRNA
attcttacatgataactcagtga

SEQ ID NO: 15785 - DNA, 23 bp, Artificial Sequence
  X-linked inhibitor of apoptosis (XIAP) siRNA
ttcttacatgataactcagtgat

SEQ ID NO: 15786 - DNA, 23 bp, Artificial Sequence
  X-linked inhibitor of apoptosis (XIAP) siRNA
tcttacatgataactcagtgatg

SEQ ID NO: 15787 - DNA, 23 bp, Artificial Sequence
  X-linked inhibitor of apoptosis (XIAP) siRNA
cttacatgataactcagtgatgc

SEQ ID NO: 15788 - DNA, 23 bp, Artificial Sequence
  X-linked inhibitor of apoptosis (XIAP) siRNA
ttacatgataactcagtgatgct

SEQ ID NO: 15789 - DNA, 23 bp, Artificial Sequence
  X-linked inhibitor of apoptosis (XIAP) siRNA
tacatgataactcagtgatgctt

SEQ ID NO: 15790 - DNA, 23 bp, Artificial Sequence
  X-linked inhibitor of apoptosis (XIAP) siRNA
acatgataactcagtgatgctta

SEQ ID NO: 15791 - DNA, 23 bp, Artificial Sequence
  X-linked inhibitor of apoptosis (XIAP) siRNA
catgataactcagtgatgcttac

SEQ ID NO: 15792 - DNA, 23 bp, Artificial Sequence
  X-linked inhibitor of apoptosis (XIAP) siRNA
atgataactcagtgatgcttact

SEQ ID NO: 15793 - DNA, 23 bp, Artificial Sequence
  X-linked inhibitor of apoptosis (XIAP) siRNA
tgataactcagtgatgcttactc

SEQ ID NO: 15794 - DNA, 23 bp, Artificial Sequence
  X-linked inhibitor of apoptosis (XIAP) siRNA
gataactcagtgatgcttactca

SEQ ID NO: 15795 - DNA, 23 bp, Artificial Sequence
  X-linked inhibitor of apoptosis (XIAP) siRNA
ataactcagtgatgcttactcat

SEQ ID NO: 15796 - DNA, 23 bp, Artificial Sequence
  X-linked inhibitor of apoptosis (XIAP) siRNA
taactcagtgatgcttactcata

SEQ ID NO: 15797 - DNA, 23 bp, Artificial Sequence
  X-linked inhibitor of apoptosis (XIAP) siRNA
aactcagtgatgcttactcatag

SEQ ID NO: 15798 - DNA, 23 bp, Artificial Sequence
  X-linked inhibitor of apoptosis (XIAP) siRNA
actcagtgatgcttactcatagt

SEQ ID NO: 15799 - DNA, 23 bp, Artificial Sequence
  X-linked inhibitor of apoptosis (XIAP) siRNA
ctcagtgatgcttactcatagtt

SEQ ID NO: 15800 - DNA, 23 bp, Artificial Sequence
  X-linked inhibitor of apoptosis (XIAP) siRNA
tcagtgatgcttactcatagttt

SEQ ID NO: 15801 - DNA, 23 bp, Artificial Sequence
  X-linked inhibitor of apoptosis (XIAP) siRNA
cagtgatgcttactcatagtttt

SEQ ID NO: 15802 - DNA, 23 bp, Artificial Sequence
  X-linked inhibitor of apoptosis (XIAP) siRNA
agtgatgcttactcatagttttt

SEQ ID NO: 15803 - DNA, 23 bp, Artificial Sequence
  X-linked inhibitor of apoptosis (XIAP) siRNA
gtgatgcttactcatagtttttg

SEQ ID NO: 15804 - DNA, 23 bp, Artificial Sequence
  X-linked inhibitor of apoptosis (XIAP) siRNA
tgatgcttactcatagtttttgg

SEQ ID NO: 15805 - DNA, 23 bp, Artificial Sequence
  X-linked inhibitor of apoptosis (XIAP) siRNA
gatgcttactcatagtttttggt

SEQ ID NO: 15806 - DNA, 23 bp, Artificial Sequence
  X-linked inhibitor of apoptosis (XIAP) siRNA
atgcttactcatagtttttggtg

SEQ ID NO: 15807 - DNA, 23 bp, Artificial Sequence
  X-linked inhibitor of apoptosis (XIAP) siRNA
tgcttactcatagtttttggtgt

SEQ ID NO: 15808 - DNA, 23 bp, Artificial Sequence
  X-linked inhibitor of apoptosis (XIAP) siRNA
gcttactcatagtttttggtgtt

SEQ ID NO: 15809 - DNA, 23 bp, Artificial Sequence
  X-linked inhibitor of apoptosis (XIAP) siRNA
cttactcatagtttttggtgttt

SEQ ID NO: 15810 - DNA, 23 bp, Artificial Sequence
  X-linked inhibitor of apoptosis (XIAP) siRNA
ttactcatagtttttggtgtttc

SEQ ID NO: 15811 - DNA, 23 bp, Artificial Sequence
  X-linked inhibitor of apoptosis (XIAP) siRNA
tactcatagtttttggtgtttct

SEQ ID NO: 15812 - DNA, 23 bp, Artificial Sequence
  X-linked inhibitor of apoptosis (XIAP) siRNA
actcatagtttttggtgtttctc

SEQ ID NO: 15813 - DNA, 23 bp, Artificial Sequence
  X-linked inhibitor of apoptosis (XIAP) siRNA
ctcatagtttttggtgtttctca

SEQ ID NO: 15814 - DNA, 23 bp, Artificial Sequence
  X-linked inhibitor of apoptosis (XIAP) siRNA
tcatagtttttggtgtttctcat

SEQ ID NO: 15815 - DNA, 23 bp, Artificial Sequence
  X-linked inhibitor of apoptosis (XIAP) siRNA
catagtttttggtgtttctcata

SEQ ID NO: 15816 - DNA, 23 bp, Artificial Sequence
  X-linked inhibitor of apoptosis (XIAP) siRNA
atagtttttggtgtttctcatag

SEQ ID NO: 15817 - DNA, 23 bp, Artificial Sequence
  X-linked inhibitor of apoptosis (XIAP) siRNA
tagtttttggtgtttctcataga

SEQ ID NO: 15818 - DNA, 23 bp, Artificial Sequence
  X-linked inhibitor of apoptosis (XIAP) siRNA
agtttttggtgtttctcatagat

SEQ ID NO: 15819 - DNA, 23 bp, Artificial Sequence
  X-linked inhibitor of apoptosis (XIAP) siRNA
gtttttggtgtttctcatagata

SEQ ID NO: 15820 - DNA, 23 bp, Artificial Sequence
  X-linked inhibitor of apoptosis (XIAP) siRNA
tttttggtgtttctcatagataa

SEQ ID NO: 15821 - DNA, 23 bp, Artificial Sequence
  X-linked inhibitor of apoptosis (XIAP) siRNA
ttttggtgtttctcatagataag

SEQ ID NO: 15822 - DNA, 23 bp, Artificial Sequence
  X-linked inhibitor of apoptosis (XIAP) siRNA
tttggtgtttctcatagataaga

SEQ ID NO: 15823 - DNA, 23 bp, Artificial Sequence
  X-linked inhibitor of apoptosis (XIAP) siRNA
ttggtgtttctcatagataagat

SEQ ID NO: 15824 - DNA, 23 bp, Artificial Sequence
  X-linked inhibitor of apoptosis (XIAP) siRNA
tggtgtttctcatagataagata

SEQ ID NO: 15825 - DNA, 23 bp, Artificial Sequence
  X-linked inhibitor of apoptosis (XIAP) siRNA
ggtgtttctcatagataagatat

SEQ ID NO: 15826 - DNA, 23 bp, Artificial Sequence
  X-linked inhibitor of apoptosis (XIAP) siRNA
gtgtttctcatagataagatata

SEQ ID NO: 15827 - DNA, 23 bp, Artificial Sequence
  X-linked inhibitor of apoptosis (XIAP) siRNA
tgtttctcatagataagatataa

SEQ ID NO: 15828 - DNA, 23 bp, Artificial Sequence
  X-linked inhibitor of apoptosis (XIAP) siRNA
gtttctcatagataagatataaa

SEQ ID NO: 15829 - DNA, 23 bp, Artificial Sequence
  X-linked inhibitor of apoptosis (XIAP) siRNA
tttctcatagataagatataaat

SEQ ID NO: 15830 - DNA, 23 bp, Artificial Sequence
  X-linked inhibitor of apoptosis (XIAP) siRNA
ttctcatagataagatataaatc

SEQ ID NO: 15831 - DNA, 23 bp, Artificial Sequence
  X-linked inhibitor of apoptosis (XIAP) siRNA
tctcatagataagatataaatca

SEQ ID NO: 15832 - DNA, 23 bp, Artificial Sequence
  X-linked inhibitor of apoptosis (XIAP) siRNA
ctcatagataagatataaatcag

SEQ ID NO: 15833 - DNA, 23 bp, Artificial Sequence
  X-linked inhibitor of apoptosis (XIAP) siRNA
tcatagataagatataaatcagc

SEQ ID NO: 15834 - DNA, 23 bp, Artificial Sequence
  X-linked inhibitor of apoptosis (XIAP) siRNA
catagataagatataaatcagct

SEQ ID NO: 15835 - DNA, 23 bp, Artificial Sequence
  X-linked inhibitor of apoptosis (XIAP) siRNA
atagataagatataaatcagctg

SEQ ID NO: 15836 - DNA, 23 bp, Artificial Sequence
  X-linked inhibitor of apoptosis (XIAP) siRNA
tagataagatataaatcagctgg

SEQ ID NO: 15837 - DNA, 23 bp, Artificial Sequence
  X-linked inhibitor of apoptosis (XIAP) siRNA
agataagatataaatcagctggg

SEQ ID NO: 15838 - DNA, 23 bp, Artificial Sequence
  X-linked inhibitor of apoptosis (XIAP) siRNA
gataagatataaatcagctgggc

SEQ ID NO: 15839 - DNA, 23 bp, Artificial Sequence
  X-linked inhibitor of apoptosis (XIAP) siRNA
ataagatataaatcagctgggcg

SEQ ID NO: 15840 - DNA, 23 bp, Artificial Sequence
  X-linked inhibitor of apoptosis (XIAP) siRNA
taagatataaatcagctgggcgc

SEQ ID NO: 15841 - DNA, 23 bp, Artificial Sequence
  X-linked inhibitor of apoptosis (XIAP) siRNA
aagatataaatcagctgggcgcg

SEQ ID NO: 15842 - DNA, 23 bp, Artificial Sequence
  X-linked inhibitor of apoptosis (XIAP) siRNA
agatataaatcagctgggcgcgg

SEQ ID NO: 15843 - DNA, 23 bp, Artificial Sequence
  X-linked inhibitor of apoptosis (XIAP) siRNA
gatataaatcagctgggcgcggt

SEQ ID NO: 15844 - DNA, 23 bp, Artificial Sequence
  X-linked inhibitor of apoptosis (XIAP) siRNA
atataaatcagctgggcgcggtg

SEQ ID NO: 15845 - DNA, 23 bp, Artificial Sequence
  X-linked inhibitor of apoptosis (XIAP) siRNA
tataaatcagctgggcgcggtgg

SEQ ID NO: 15846 - DNA, 23 bp, Artificial Sequence
  X-linked inhibitor of apoptosis (XIAP) siRNA
ataaatcagctgggcgcggtggc

SEQ ID NO: 15847 - DNA, 23 bp, Artificial Sequence
  X-linked inhibitor of apoptosis (XIAP) siRNA
taaatcagctgggcgcggtggct

SEQ ID NO: 15848 - DNA, 23 bp, Artificial Sequence
  X-linked inhibitor of apoptosis (XIAP) siRNA
aaatcagctgggcgcggtggctc

SEQ ID NO: 15849 - DNA, 23 bp, Artificial Sequence
  X-linked inhibitor of apoptosis (XIAP) siRNA
aatcagctgggcgcggtggctca

SEQ ID NO: 15850 - DNA, 23 bp, Artificial Sequence
  X-linked inhibitor of apoptosis (XIAP) siRNA
atcagctgggcgcggtggctcat

SEQ ID NO: 15851 - DNA, 23 bp, Artificial Sequence
  X-linked inhibitor of apoptosis (XIAP) siRNA
tcagctgggcgcggtggctcatg

SEQ ID NO: 15852 - DNA, 23 bp, Artificial Sequence
  X-linked inhibitor of apoptosis (XIAP) siRNA
cagctgggcgcggtggctcatgc

SEQ ID NO: 15853 - DNA, 23 bp, Artificial Sequence
  X-linked inhibitor of apoptosis (XIAP) siRNA
agctgggcgcggtggctcatgcc

SEQ ID NO: 15854 - DNA, 23 bp, Artificial Sequence
  X-linked inhibitor of apoptosis (XIAP) siRNA
gctgggcgcggtggctcatgcct

SEQ ID NO: 15855 - DNA, 23 bp, Artificial Sequence
  X-linked inhibitor of apoptosis (XIAP) siRNA
ctgggcgcggtggctcatgcctg

SEQ ID NO: 15856 - DNA, 23 bp, Artificial Sequence
  X-linked inhibitor of apoptosis (XIAP) siRNA
tgggcgcggtggctcatgcctgt

SEQ ID NO: 15857 - DNA, 23 bp, Artificial Sequence
  X-linked inhibitor of apoptosis (XIAP) siRNA
gggcgcggtggctcatgcctgta

SEQ ID NO: 15858 - DNA, 23 bp, Artificial Sequence
  X-linked inhibitor of apoptosis (XIAP) siRNA
ggcgcggtggctcatgcctgtaa

SEQ ID NO: 15859 - DNA, 23 bp, Artificial Sequence
  X-linked inhibitor of apoptosis (XIAP) siRNA
gcgcggtggctcatgcctgtaat

SEQ ID NO: 15860 - DNA, 23 bp, Artificial Sequence
  X-linked inhibitor of apoptosis (XIAP) siRNA
cgcggtggctcatgcctgtaatc

SEQ ID NO: 15861 - DNA, 23 bp, Artificial Sequence
  X-linked inhibitor of apoptosis (XIAP) siRNA
gcggtggctcatgcctgtaatcc

SEQ ID NO: 15862 - DNA, 23 bp, Artificial Sequence
  X-linked inhibitor of apoptosis (XIAP) siRNA
cggtggctcatgcctgtaatccc

SEQ ID NO: 15863 - DNA, 23 bp, Artificial Sequence
  X-linked inhibitor of apoptosis (XIAP) siRNA
ggtggctcatgcctgtaatccca

SEQ ID NO: 15864 - DNA, 23 bp, Artificial Sequence
  X-linked inhibitor of apoptosis (XIAP) siRNA
gtggctcatgcctgtaatcccag

SEQ ID NO: 15865 - DNA, 23 bp, Artificial Sequence
  X-linked inhibitor of apoptosis (XIAP) siRNA
tggctcatgcctgtaatcccagc

SEQ ID NO: 15866 - DNA, 23 bp, Artificial Sequence
  X-linked inhibitor of apoptosis (XIAP) siRNA
ggctcatgcctgtaatcccagca

SEQ ID NO: 15867 - DNA, 23 bp, Artificial Sequence
  X-linked inhibitor of apoptosis (XIAP) siRNA
gctcatgcctgtaatcccagcac

SEQ ID NO: 15868 - DNA, 23 bp, Artificial Sequence
  X-linked inhibitor of apoptosis (XIAP) siRNA
ctcatgcctgtaatcccagcact

SEQ ID NO: 15869 - DNA, 23 bp, Artificial Sequence
  X-linked inhibitor of apoptosis (XIAP) siRNA
tcatgcctgtaatcccagcactt

SEQ ID NO: 15870 - DNA, 23 bp, Artificial Sequence
  X-linked inhibitor of apoptosis (XIAP) siRNA
catgcctgtaatcccagcacttt

SEQ ID NO: 15871 - DNA, 23 bp, Artificial Sequence
  X-linked inhibitor of apoptosis (XIAP) siRNA
atgcctgtaatcccagcactttg

SEQ ID NO: 15872 - DNA, 23 bp, Artificial Sequence
  X-linked inhibitor of apoptosis (XIAP) siRNA
tgcctgtaatcccagcactttgg

SEQ ID NO: 15873 - DNA, 23 bp, Artificial Sequence
  X-linked inhibitor of apoptosis (XIAP) siRNA
gcctgtaatcccagcactttggg

SEQ ID NO: 15874 - DNA, 23 bp, Artificial Sequence
  X-linked inhibitor of apoptosis (XIAP) siRNA
cctgtaatcccagcactttggga

SEQ ID NO: 15875 - DNA, 23 bp, Artificial Sequence
  X-linked inhibitor of apoptosis (XIAP) siRNA
ctgtaatcccagcactttgggag

SEQ ID NO: 15876 - DNA, 23 bp, Artificial Sequence
  X-linked inhibitor of apoptosis (XIAP) siRNA
tgtaatcccagcactttgggagg

SEQ ID NO: 15877 - DNA, 23 bp, Artificial Sequence
  X-linked inhibitor of apoptosis (XIAP) siRNA
gtaatcccagcactttgggaggc

SEQ ID NO: 15878 - DNA, 23 bp, Artificial Sequence
  X-linked inhibitor of apoptosis (XIAP) siRNA
taatcccagcactttgggaggcc

SEQ ID NO: 15879 - DNA, 23 bp, Artificial Sequence
  X-linked inhibitor of apoptosis (XIAP) siRNA
aatcccagcactttgggaggccg

SEQ ID NO: 15880 - DNA, 23 bp, Artificial Sequence
  X-linked inhibitor of apoptosis (XIAP) siRNA
atcccagcactttgggaggccga

SEQ ID NO: 15881 - DNA, 23 bp, Artificial Sequence
  X-linked inhibitor of apoptosis (XIAP) siRNA
tcccagcactttgggaggccgag

SEQ ID NO: 15882 - DNA, 23 bp, Artificial Sequence
  X-linked inhibitor of apoptosis (XIAP) siRNA
cccagcactttgggaggccgagg

SEQ ID NO: 15883 - DNA, 23 bp, Artificial Sequence
  X-linked inhibitor of apoptosis (XIAP) siRNA
ccagcactttgggaggccgaggc

SEQ ID NO: 15884 - DNA, 23 bp, Artificial Sequence
  X-linked inhibitor of apoptosis (XIAP) siRNA
cagcactttgggaggccgaggcg

SEQ ID NO: 15885 - DNA, 23 bp, Artificial Sequence
  X-linked inhibitor of apoptosis (XIAP) siRNA
agcactttgggaggccgaggcgg

SEQ ID NO: 15886 - DNA, 23 bp, Artificial Sequence
  X-linked inhibitor of apoptosis (XIAP) siRNA
gcactttgggaggccgaggcggg

SEQ ID NO: 15887 - DNA, 23 bp, Artificial Sequence
  X-linked inhibitor of apoptosis (XIAP) siRNA
cactttgggaggccgaggcgggc

SEQ ID NO: 15888 - DNA, 23 bp, Artificial Sequence
  X-linked inhibitor of apoptosis (XIAP) siRNA
actttgggaggccgaggcgggca

SEQ ID NO: 15889 - DNA, 23 bp, Artificial Sequence
  X-linked inhibitor of apoptosis (XIAP) siRNA
ctttgggaggccgaggcgggcag

SEQ ID NO: 15890 - DNA, 23 bp, Artificial Sequence
  X-linked inhibitor of apoptosis (XIAP) siRNA
tttgggaggccgaggcgggcaga

SEQ ID NO: 15891 - DNA, 23 bp, Artificial Sequence
  X-linked inhibitor of apoptosis (XIAP) siRNA
ttgggaggccgaggcgggcagat

SEQ ID NO: 15892 - DNA, 23 bp, Artificial Sequence
  X-linked inhibitor of apoptosis (XIAP) siRNA
tgggaggccgaggcgggcagatc

SEQ ID NO: 15893 - DNA, 23 bp, Artificial Sequence
  X-linked inhibitor of apoptosis (XIAP) siRNA
gggaggccgaggcgggcagatca

SEQ ID NO: 15894 - DNA, 23 bp, Artificial Sequence
  X-linked inhibitor of apoptosis (XIAP) siRNA
ggaggccgaggcgggcagatcac

SEQ ID NO: 15895 - DNA, 23 bp, Artificial Sequence
  X-linked inhibitor of apoptosis (XIAP) siRNA
gaggccgaggcgggcagatcacc

SEQ ID NO: 15896 - DNA, 23 bp, Artificial Sequence
  X-linked inhibitor of apoptosis (XIAP) siRNA
aggccgaggcgggcagatcacct

SEQ ID NO: 15897 - DNA, 23 bp, Artificial Sequence
  X-linked inhibitor of apoptosis (XIAP) siRNA
ggccgaggcgggcagatcacctg

SEQ ID NO: 15898 - DNA, 23 bp, Artificial Sequence
  X-linked inhibitor of apoptosis (XIAP) siRNA
gccgaggcgggcagatcacctga

SEQ ID NO: 15899 - DNA, 23 bp, Artificial Sequence
  X-linked inhibitor of apoptosis (XIAP) siRNA
ccgaggcgggcagatcacctgag

SEQ ID NO: 15900 - DNA, 23 bp, Artificial Sequence
  X-linked inhibitor of apoptosis (XIAP) siRNA
cgaggcgggcagatcacctgagg

SEQ ID NO: 15901 - DNA, 23 bp, Artificial Sequence
  X-linked inhibitor of apoptosis (XIAP) siRNA
gaggcgggcagatcacctgaggt

SEQ ID NO: 15902 - DNA, 23 bp, Artificial Sequence
  X-linked inhibitor of apoptosis (XIAP) siRNA
aggcgggcagatcacctgaggtc

SEQ ID NO: 15903 - DNA, 23 bp, Artificial Sequence
  X-linked inhibitor of apoptosis (XIAP) siRNA
ggcgggcagatcacctgaggtcg

SEQ ID NO: 15904 - DNA, 23 bp, Artificial Sequence
  X-linked inhibitor of apoptosis (XIAP) siRNA
gcgggcagatcacctgaggtcgg

SEQ ID NO: 15905 - DNA, 23 bp, Artificial Sequence
  X-linked inhibitor of apoptosis (XIAP) siRNA
cgggcagatcacctgaggtcggg

SEQ ID NO: 15906 - DNA, 23 bp, Artificial Sequence
  X-linked inhibitor of apoptosis (XIAP) siRNA
gggcagatcacctgaggtcggga

SEQ ID NO: 15907 - DNA, 23 bp, Artificial Sequence
  X-linked inhibitor of apoptosis (XIAP) siRNA
ggcagatcacctgaggtcgggag

SEQ ID NO: 15908 - DNA, 23 bp, Artificial Sequence
  X-linked inhibitor of apoptosis (XIAP) siRNA
gcagatcacctgaggtcgggagg

SEQ ID NO: 15909 - DNA, 23 bp, Artificial Sequence
  X-linked inhibitor of apoptosis (XIAP) siRNA
cagatcacctgaggtcgggaggt

SEQ ID NO: 15910 - DNA, 23 bp, Artificial Sequence
  X-linked inhibitor of apoptosis (XIAP) siRNA
agatcacctgaggtcgggaggtc

SEQ ID NO: 15911 - DNA, 23 bp, Artificial Sequence
  X-linked inhibitor of apoptosis (XIAP) siRNA
gatcacctgaggtcgggaggtcg

SEQ ID NO: 15912 - DNA, 23 bp, Artificial Sequence
  X-linked inhibitor of apoptosis (XIAP) siRNA
atcacctgaggtcgggaggtcga

SEQ ID NO: 15913 - DNA, 23 bp, Artificial Sequence
  X-linked inhibitor of apoptosis (XIAP) siRNA
tcacctgaggtcgggaggtcgag

SEQ ID NO: 15914 - DNA, 23 bp, Artificial Sequence
  X-linked inhibitor of apoptosis (XIAP) siRNA
cacctgaggtcgggaggtcgaga

SEQ ID NO: 15915 - DNA, 23 bp, Artificial Sequence
  X-linked inhibitor of apoptosis (XIAP) siRNA
acctgaggtcgggaggtcgagac

SEQ ID NO: 15916 - DNA, 23 bp, Artificial Sequence
  X-linked inhibitor of apoptosis (XIAP) siRNA
cctgaggtcgggaggtcgagacc

SEQ ID NO: 15917 - DNA, 23 bp, Artificial Sequence
  X-linked inhibitor of apoptosis (XIAP) siRNA
ctgaggtcgggaggtcgagacca

SEQ ID NO: 15918 - DNA, 23 bp, Artificial Sequence
  X-linked inhibitor of apoptosis (XIAP) siRNA
tgaggtcgggaggtcgagaccag

SEQ ID NO: 15919 - DNA, 23 bp, Artificial Sequence
  X-linked inhibitor of apoptosis (XIAP) siRNA
gaggtcgggaggtcgagaccagc

SEQ ID NO: 15920 - DNA, 23 bp, Artificial Sequence
  X-linked inhibitor of apoptosis (XIAP) siRNA
aggtcgggaggtcgagaccagcc

SEQ ID NO: 15921 - DNA, 23 bp, Artificial Sequence
  X-linked inhibitor of apoptosis (XIAP) siRNA
ggtcgggaggtcgagaccagcct

SEQ ID NO: 15922 - DNA, 23 bp, Artificial Sequence
  X-linked inhibitor of apoptosis (XIAP) siRNA
gtcgggaggtcgagaccagcctg

SEQ ID NO: 15923 - DNA, 23 bp, Artificial Sequence
  X-linked inhibitor of apoptosis (XIAP) siRNA
tcgggaggtcgagaccagcctga

SEQ ID NO: 15924 - DNA, 23 bp, Artificial Sequence
  X-linked inhibitor of apoptosis (XIAP) siRNA
cgggaggtcgagaccagcctgac

SEQ ID NO: 15925 - DNA, 23 bp, Artificial Sequence
  X-linked inhibitor of apoptosis (XIAP) siRNA
gggaggtcgagaccagcctgacc

SEQ ID NO: 15926 - DNA, 23 bp, Artificial Sequence
  X-linked inhibitor of apoptosis (XIAP) siRNA
ggaggtcgagaccagcctgacca

SEQ ID NO: 15927 - DNA, 23 bp, Artificial Sequence
  X-linked inhibitor of apoptosis (XIAP) siRNA
gaggtcgagaccagcctgaccaa

SEQ ID NO: 15928 - DNA, 23 bp, Artificial Sequence
  X-linked inhibitor of apoptosis (XIAP) siRNA
aggtcgagaccagcctgaccaac

SEQ ID NO: 15929 - DNA, 23 bp, Artificial Sequence
  X-linked inhibitor of apoptosis (XIAP) siRNA
ggtcgagaccagcctgaccaaca

SEQ ID NO: 15930 - DNA, 23 bp, Artificial Sequence
  X-linked inhibitor of apoptosis (XIAP) siRNA
gtcgagaccagcctgaccaacat

SEQ ID NO: 15931 - DNA, 23 bp, Artificial Sequence
  X-linked inhibitor of apoptosis (XIAP) siRNA
tcgagaccagcctgaccaacatg

SEQ ID NO: 15932 - DNA, 23 bp, Artificial Sequence
  X-linked inhibitor of apoptosis (XIAP) siRNA
cgagaccagcctgaccaacatgg

SEQ ID NO: 15933 - DNA, 23 bp, Artificial Sequence
  X-linked inhibitor of apoptosis (XIAP) siRNA
gagaccagcctgaccaacatgga

SEQ ID NO: 15934 - DNA, 23 bp, Artificial Sequence
  X-linked inhibitor of apoptosis (XIAP) siRNA
agaccagcctgaccaacatggag

SEQ ID NO: 15935 - DNA, 23 bp, Artificial Sequence
  X-linked inhibitor of apoptosis (XIAP) siRNA
gaccagcctgaccaacatggaga

SEQ ID NO: 15936 - DNA, 23 bp, Artificial Sequence
  X-linked inhibitor of apoptosis (XIAP) siRNA
accagcctgaccaacatggagaa

SEQ ID NO: 15937 - DNA, 23 bp, Artificial Sequence
  X-linked inhibitor of apoptosis (XIAP) siRNA
ccagcctgaccaacatggagaaa

SEQ ID NO: 15938 - DNA, 23 bp, Artificial Sequence
  X-linked inhibitor of apoptosis (XIAP) siRNA
cagcctgaccaacatggagaaac

SEQ ID NO: 15939 - DNA, 23 bp, Artificial Sequence
  X-linked inhibitor of apoptosis (XIAP) siRNA
agcctgaccaacatggagaaacc

SEQ ID NO: 15940 - DNA, 23 bp, Artificial Sequence
  X-linked inhibitor of apoptosis (XIAP) siRNA
gcctgaccaacatggagaaaccc

SEQ ID NO: 15941 - DNA, 23 bp, Artificial Sequence
  X-linked inhibitor of apoptosis (XIAP) siRNA
cctgaccaacatggagaaacccc

SEQ ID NO: 15942 - DNA, 23 bp, Artificial Sequence
  X-linked inhibitor of apoptosis (XIAP) siRNA
ctgaccaacatggagaaaccccg

SEQ ID NO: 15943 - DNA, 23 bp, Artificial Sequence
  X-linked inhibitor of apoptosis (XIAP) siRNA
tgaccaacatggagaaaccccgt

SEQ ID NO: 15944 - DNA, 23 bp, Artificial Sequence
  X-linked inhibitor of apoptosis (XIAP) siRNA
gaccaacatggagaaaccccgtc

SEQ ID NO: 15945 - DNA, 23 bp, Artificial Sequence
  X-linked inhibitor of apoptosis (XIAP) siRNA
accaacatggagaaaccccgtct

SEQ ID NO: 15946 - DNA, 23 bp, Artificial Sequence
  X-linked inhibitor of apoptosis (XIAP) siRNA
ccaacatggagaaaccccgtctc

SEQ ID NO: 15947 - DNA, 23 bp, Artificial Sequence
  X-linked inhibitor of apoptosis (XIAP) siRNA
caacatggagaaaccccgtctct

SEQ ID NO: 15948 - DNA, 23 bp, Artificial Sequence
  X-linked inhibitor of apoptosis (XIAP) siRNA
aacatggagaaaccccgtctcta

SEQ ID NO: 15949 - DNA, 23 bp, Artificial Sequence
  X-linked inhibitor of apoptosis (XIAP) siRNA
acatggagaaaccccgtctctac

SEQ ID NO: 15950 - DNA, 23 bp, Artificial Sequence
  X-linked inhibitor of apoptosis (XIAP) siRNA
catggagaaaccccgtctctact

SEQ ID NO: 15951 - DNA, 23 bp, Artificial Sequence
  X-linked inhibitor of apoptosis (XIAP) siRNA
atggagaaaccccgtctctacta

SEQ ID NO: 15952 - DNA, 23 bp, Artificial Sequence
  X-linked inhibitor of apoptosis (XIAP) siRNA
tggagaaaccccgtctctactaa

SEQ ID NO: 15953 - DNA, 23 bp, Artificial Sequence
  X-linked inhibitor of apoptosis (XIAP) siRNA
ggagaaaccccgtctctactaaa

SEQ ID NO: 15954 - DNA, 23 bp, Artificial Sequence
  X-linked inhibitor of apoptosis (XIAP) siRNA
gagaaaccccgtctctactaaaa

SEQ ID NO: 15955 - DNA, 23 bp, Artificial Sequence
  X-linked inhibitor of apoptosis (XIAP) siRNA
agaaaccccgtctctactaaaaa

SEQ ID NO: 15956 - DNA, 23 bp, Artificial Sequence
  X-linked inhibitor of apoptosis (XIAP) siRNA
gaaaccccgtctctactaaaaat

SEQ ID NO: 15957 - DNA, 23 bp, Artificial Sequence
  X-linked inhibitor of apoptosis (XIAP) siRNA
aaaccccgtctctactaaaaata

SEQ ID NO: 15958 - DNA, 23 bp, Artificial Sequence
  X-linked inhibitor of apoptosis (XIAP) siRNA
aaccccgtctctactaaaaatac

SEQ ID NO: 15959 - DNA, 23 bp, Artificial Sequence
  X-linked inhibitor of apoptosis (XIAP) siRNA
accccgtctctactaaaaataca

SEQ ID NO: 15960 - DNA, 23 bp, Artificial Sequence
  X-linked inhibitor of apoptosis (XIAP) siRNA
ccccgtctctactaaaaatacaa

SEQ ID NO: 15961 - DNA, 23 bp, Artificial Sequence
  X-linked inhibitor of apoptosis (XIAP) siRNA
cccgtctctactaaaaatacaaa

SEQ ID NO: 15962 - DNA, 23 bp, Artificial Sequence
  X-linked inhibitor of apoptosis (XIAP) siRNA
ccgtctctactaaaaatacaaaa

SEQ ID NO: 15963 - DNA, 23 bp, Artificial Sequence
  X-linked inhibitor of apoptosis (XIAP) siRNA
cgtctctactaaaaatacaaaat

SEQ ID NO: 15964 - DNA, 23 bp, Artificial Sequence
  X-linked inhibitor of apoptosis (XIAP) siRNA
gtctctactaaaaatacaaaatt

SEQ ID NO: 15965 - DNA, 23 bp, Artificial Sequence
  X-linked inhibitor of apoptosis (XIAP) siRNA
tctctactaaaaatacaaaatta

SEQ ID NO: 15966 - DNA, 23 bp, Artificial Sequence
  X-linked inhibitor of apoptosis (XIAP) siRNA
ctctactaaaaatacaaaattag

SEQ ID NO: 15967 - DNA, 23 bp, Artificial Sequence
  X-linked inhibitor of apoptosis (XIAP) siRNA
tctactaaaaatacaaaattagc

SEQ ID NO: 15968 - DNA, 23 bp, Artificial Sequence
  X-linked inhibitor of apoptosis (XIAP) siRNA
ctactaaaaatacaaaattagct

SEQ ID NO: 15969 - DNA, 23 bp, Artificial Sequence
  X-linked inhibitor of apoptosis (XIAP) siRNA
tactaaaaatacaaaattagctg

SEQ ID NO: 15970 - DNA, 23 bp, Artificial Sequence
  X-linked inhibitor of apoptosis (XIAP) siRNA
actaaaaatacaaaattagctgg

SEQ ID NO: 15971 - DNA, 23 bp, Artificial Sequence
  X-linked inhibitor of apoptosis (XIAP) siRNA
ctaaaaatacaaaattagctggg

SEQ ID NO: 15972 - DNA, 23 bp, Artificial Sequence
  X-linked inhibitor of apoptosis (XIAP) siRNA
taaaaatacaaaattagctgggc

SEQ ID NO: 15973 - DNA, 23 bp, Artificial Sequence
  X-linked inhibitor of apoptosis (XIAP) siRNA
aaaaatacaaaattagctgggcg

SEQ ID NO: 15974 - DNA, 23 bp, Artificial Sequence
  X-linked inhibitor of apoptosis (XIAP) siRNA
aaaatacaaaattagctgggcgt

SEQ ID NO: 15975 - DNA, 23 bp, Artificial Sequence
  X-linked inhibitor of apoptosis (XIAP) siRNA
aaatacaaaattagctgggcgtg

SEQ ID NO: 15976 - DNA, 23 bp, Artificial Sequence
  X-linked inhibitor of apoptosis (XIAP) siRNA
aatacaaaattagctgggcgtgg

SEQ ID NO: 15977 - DNA, 23 bp, Artificial Sequence
  X-linked inhibitor of apoptosis (XIAP) siRNA
atacaaaattagctgggcgtggt

SEQ ID NO: 15978 - DNA, 23 bp, Artificial Sequence
  X-linked inhibitor of apoptosis (XIAP) siRNA
tacaaaattagctgggcgtggtg

SEQ ID NO: 15979 - DNA, 23 bp, Artificial Sequence
  X-linked inhibitor of apoptosis (XIAP) siRNA
acaaaattagctgggcgtggtgg

SEQ ID NO: 15980 - DNA, 23 bp, Artificial Sequence
  X-linked inhibitor of apoptosis (XIAP) siRNA
caaaattagctgggcgtggtggc

SEQ ID NO: 15981 - DNA, 23 bp, Artificial Sequence
  X-linked inhibitor of apoptosis (XIAP) siRNA
aaaattagctgggcgtggtggct

SEQ ID NO: 15982 - DNA, 23 bp, Artificial Sequence
  X-linked inhibitor of apoptosis (XIAP) siRNA
aaattagctgggcgtggtggctc

SEQ ID NO: 15983 - DNA, 23 bp, Artificial Sequence
  X-linked inhibitor of apoptosis (XIAP) siRNA
aattagctgggcgtggtggctca

SEQ ID NO: 15984 - DNA, 23 bp, Artificial Sequence
  X-linked inhibitor of apoptosis (XIAP) siRNA
attagctgggcgtggtggctcat

SEQ ID NO: 15985 - DNA, 23 bp, Artificial Sequence
  X-linked inhibitor of apoptosis (XIAP) siRNA
ttagctgggcgtggtggctcatg

SEQ ID NO: 15986 - DNA, 23 bp, Artificial Sequence
  X-linked inhibitor of apoptosis (XIAP) siRNA
tagctgggcgtggtggctcatgc

SEQ ID NO: 15987 - DNA, 23 bp, Artificial Sequence
  X-linked inhibitor of apoptosis (XIAP) siRNA
agctgggcgtggtggctcatgcc

SEQ ID NO: 15988 - DNA, 23 bp, Artificial Sequence
  X-linked inhibitor of apoptosis (XIAP) siRNA
gctgggcgtggtggctcatgcct

SEQ ID NO: 15989 - DNA, 23 bp, Artificial Sequence
  X-linked inhibitor of apoptosis (XIAP) siRNA
ctgggcgtggtggctcatgcctg

SEQ ID NO: 15990 - DNA, 23 bp, Artificial Sequence
  X-linked inhibitor of apoptosis (XIAP) siRNA
tgggcgtggtggctcatgcctgt

SEQ ID NO: 15991 - DNA, 23 bp, Artificial Sequence
  X-linked inhibitor of apoptosis (XIAP) siRNA
gggcgtggtggctcatgcctgta

SEQ ID NO: 15992 - DNA, 23 bp, Artificial Sequence
  X-linked inhibitor of apoptosis (XIAP) siRNA
ggcgtggtggctcatgcctgtaa

SEQ ID NO: 15993 - DNA, 23 bp, Artificial Sequence
  X-linked inhibitor of apoptosis (XIAP) siRNA
gcgtggtggctcatgcctgtaat

SEQ ID NO: 15994 - DNA, 23 bp, Artificial Sequence
  X-linked inhibitor of apoptosis (XIAP) siRNA
cgtggtggctcatgcctgtaatc

SEQ ID NO: 15995 - DNA, 23 bp, Artificial Sequence
  X-linked inhibitor of apoptosis (XIAP) siRNA
gtggtggctcatgcctgtaatcc

SEQ ID NO: 15996 - DNA, 23 bp, Artificial Sequence
  X-linked inhibitor of apoptosis (XIAP) siRNA
tggtggctcatgcctgtaatccc

SEQ ID NO: 15997 - DNA, 23 bp, Artificial Sequence
  X-linked inhibitor of apoptosis (XIAP) siRNA
ggtggctcatgcctgtaatccca

SEQ ID NO: 15998 - DNA, 23 bp, Artificial Sequence
  X-linked inhibitor of apoptosis (XIAP) siRNA
gtggctcatgcctgtaatcccag

SEQ ID NO: 15999 - DNA, 23 bp, Artificial Sequence
  X-linked inhibitor of apoptosis (XIAP) siRNA
tggctcatgcctgtaatcccagc

SEQ ID NO: 16000 - DNA, 23 bp, Artificial Sequence
  X-linked inhibitor of apoptosis (XIAP) siRNA
ggctcatgcctgtaatcccagct

SEQ ID NO: 16001 - DNA, 23 bp, Artificial Sequence
  X-linked inhibitor of apoptosis (XIAP) siRNA
gctcatgcctgtaatcccagcta

SEQ ID NO: 16002 - DNA, 23 bp, Artificial Sequence
  X-linked inhibitor of apoptosis (XIAP) siRNA
ctcatgcctgtaatcccagctac

SEQ ID NO: 16003 - DNA, 23 bp, Artificial Sequence
  X-linked inhibitor of apoptosis (XIAP) siRNA
tcatgcctgtaatcccagctact

SEQ ID NO: 16004 - DNA, 23 bp, Artificial Sequence
  X-linked inhibitor of apoptosis (XIAP) siRNA
catgcctgtaatcccagctactt

SEQ ID NO: 16005 - DNA, 23 bp, Artificial Sequence
  X-linked inhibitor of apoptosis (XIAP) siRNA
atgcctgtaatcccagctacttg

SEQ ID NO: 16006 - DNA, 23 bp, Artificial Sequence
  X-linked inhibitor of apoptosis (XIAP) siRNA
tgcctgtaatcccagctacttgg

SEQ ID NO: 16007 - DNA, 23 bp, Artificial Sequence
  X-linked inhibitor of apoptosis (XIAP) siRNA
gcctgtaatcccagctacttggg

SEQ ID NO: 16008 - DNA, 23 bp, Artificial Sequence
  X-linked inhibitor of apoptosis (XIAP) siRNA
cctgtaatcccagctacttggga

SEQ ID NO: 16009 - DNA, 23 bp, Artificial Sequence
  X-linked inhibitor of apoptosis (XIAP) siRNA
ctgtaatcccagctacttgggag

SEQ ID NO: 16010 - DNA, 23 bp, Artificial Sequence
  X-linked inhibitor of apoptosis (XIAP) siRNA
tgtaatcccagctacttgggagg

SEQ ID NO: 16011 - DNA, 23 bp, Artificial Sequence
  X-linked inhibitor of apoptosis (XIAP) siRNA
gtaatcccagctacttgggaggc

SEQ ID NO: 16012 - DNA, 23 bp, Artificial Sequence
  X-linked inhibitor of apoptosis (XIAP) siRNA
taatcccagctacttgggaggct

SEQ ID NO: 16013 - DNA, 23 bp, Artificial Sequence
  X-linked inhibitor of apoptosis (XIAP) siRNA
aatcccagctacttgggaggctg

SEQ ID NO: 16014 - DNA, 23 bp, Artificial Sequence
  X-linked inhibitor of apoptosis (XIAP) siRNA
atcccagctacttgggaggctga

SEQ ID NO: 16015 - DNA, 23 bp, Artificial Sequence
  X-linked inhibitor of apoptosis (XIAP) siRNA
tcccagctacttgggaggctgag

SEQ ID NO: 16016 - DNA, 23 bp, Artificial Sequence
  X-linked inhibitor of apoptosis (XIAP) siRNA
cccagctacttgggaggctgagg

SEQ ID NO: 16017 - DNA, 23 bp, Artificial Sequence
  X-linked inhibitor of apoptosis (XIAP) siRNA
ccagctacttgggaggctgaggc

SEQ ID NO: 16018 - DNA, 23 bp, Artificial Sequence
  X-linked inhibitor of apoptosis (XIAP) siRNA
cagctacttgggaggctgaggca

SEQ ID NO: 16019 - DNA, 23 bp, Artificial Sequence
  X-linked inhibitor of apoptosis (XIAP) siRNA
agctacttgggaggctgaggcag

SEQ ID NO: 16020 - DNA, 23 bp, Artificial Sequence
  X-linked inhibitor of apoptosis (XIAP) siRNA
gctacttgggaggctgaggcagg

SEQ ID NO: 16021 - DNA, 23 bp, Artificial Sequence
  X-linked inhibitor of apoptosis (XIAP) siRNA
ctacttgggaggctgaggcagga

SEQ ID NO: 16022 - DNA, 23 bp, Artificial Sequence
  X-linked inhibitor of apoptosis (XIAP) siRNA
tacttgggaggctgaggcaggag

SEQ ID NO: 16023 - DNA, 23 bp, Artificial Sequence
  X-linked inhibitor of apoptosis (XIAP) siRNA
acttgggaggctgaggcaggaga

SEQ ID NO: 16024 - DNA, 23 bp, Artificial Sequence
  X-linked inhibitor of apoptosis (XIAP) siRNA
cttgggaggctgaggcaggagaa

SEQ ID NO: 16025 - DNA, 23 bp, Artificial Sequence
  X-linked inhibitor of apoptosis (XIAP) siRNA
ttgggaggctgaggcaggagaat

SEQ ID NO: 16026 - DNA, 23 bp, Artificial Sequence
  X-linked inhibitor of apoptosis (XIAP) siRNA
tgggaggctgaggcaggagaatc

SEQ ID NO: 16027 - DNA, 23 bp, Artificial Sequence
  X-linked inhibitor of apoptosis (XIAP) siRNA
gggaggctgaggcaggagaatcg

SEQ ID NO: 16028 - DNA, 23 bp, Artificial Sequence
  X-linked inhibitor of apoptosis (XIAP) siRNA
ggaggctgaggcaggagaatcgc

SEQ ID NO: 16029 - DNA, 23 bp, Artificial Sequence
  X-linked inhibitor of apoptosis (XIAP) siRNA
gaggctgaggcaggagaatcgct

SEQ ID NO: 16030 - DNA, 23 bp, Artificial Sequence
  X-linked inhibitor of apoptosis (XIAP) siRNA
aggctgaggcaggagaatcgctt

SEQ ID NO: 16031 - DNA, 23 bp, Artificial Sequence
  X-linked inhibitor of apoptosis (XIAP) siRNA
ggctgaggcaggagaatcgcttg

SEQ ID NO: 16032 - DNA, 23 bp, Artificial Sequence
  X-linked inhibitor of apoptosis (XIAP) siRNA
gctgaggcaggagaatcgcttga

SEQ ID NO: 16033 - DNA, 23 bp, Artificial Sequence
  X-linked inhibitor of apoptosis (XIAP) siRNA
ctgaggcaggagaatcgcttgaa

SEQ ID NO: 16034 - DNA, 23 bp, Artificial Sequence
  X-linked inhibitor of apoptosis (XIAP) siRNA
tgaggcaggagaatcgcttgaac

SEQ ID NO: 16035 - DNA, 23 bp, Artificial Sequence
  X-linked inhibitor of apoptosis (XIAP) siRNA
gaggcaggagaatcgcttgaacc

SEQ ID NO: 16036 - DNA, 23 bp, Artificial Sequence
  X-linked inhibitor of apoptosis (XIAP) siRNA
aggcaggagaatcgcttgaaccc

SEQ ID NO: 16037 - DNA, 23 bp, Artificial Sequence
  X-linked inhibitor of apoptosis (XIAP) siRNA
ggcaggagaatcgcttgaaccca

SEQ ID NO: 16038 - DNA, 23 bp, Artificial Sequence
  X-linked inhibitor of apoptosis (XIAP) siRNA
gcaggagaatcgcttgaacccag

SEQ ID NO: 16039 - DNA, 23 bp, Artificial Sequence
  X-linked inhibitor of apoptosis (XIAP) siRNA
caggagaatcgcttgaacccagg

SEQ ID NO: 16040 - DNA, 23 bp, Artificial Sequence
  X-linked inhibitor of apoptosis (XIAP) siRNA
aggagaatcgcttgaacccagga

SEQ ID NO: 16041 - DNA, 23 bp, Artificial Sequence
  X-linked inhibitor of apoptosis (XIAP) siRNA
ggagaatcgcttgaacccaggag

SEQ ID NO: 16042 - DNA, 23 bp, Artificial Sequence
  X-linked inhibitor of apoptosis (XIAP) siRNA
gagaatcgcttgaacccaggagg

SEQ ID NO: 16043 - DNA, 23 bp, Artificial Sequence
  X-linked inhibitor of apoptosis (XIAP) siRNA
agaatcgcttgaacccaggaggc

SEQ ID NO: 16044 - DNA, 23 bp, Artificial Sequence
  X-linked inhibitor of apoptosis (XIAP) siRNA
gaatcgcttgaacccaggaggcg

SEQ ID NO: 16045 - DNA, 23 bp, Artificial Sequence
  X-linked inhibitor of apoptosis (XIAP) siRNA
aatcgcttgaacccaggaggcgg

SEQ ID NO: 16046 - DNA, 23 bp, Artificial Sequence
  X-linked inhibitor of apoptosis (XIAP) siRNA
atcgcttgaacccaggaggcgga

SEQ ID NO: 16047 - DNA, 23 bp, Artificial Sequence
  X-linked inhibitor of apoptosis (XIAP) siRNA
tcgcttgaacccaggaggcggag

SEQ ID NO: 16048 - DNA, 23 bp, Artificial Sequence
  X-linked inhibitor of apoptosis (XIAP) siRNA
cgcttgaacccaggaggcggagg

SEQ ID NO: 16049 - DNA, 23 bp, Artificial Sequence
  X-linked inhibitor of apoptosis (XIAP) siRNA
gcttgaacccaggaggcggaggt

SEQ ID NO: 16050 - DNA, 23 bp, Artificial Sequence
  X-linked inhibitor of apoptosis (XIAP) siRNA
cttgaacccaggaggcggaggtt

SEQ ID NO: 16051 - DNA, 23 bp, Artificial Sequence
  X-linked inhibitor of apoptosis (XIAP) siRNA
ttgaacccaggaggcggaggttg

SEQ ID NO: 16052 - DNA, 23 bp, Artificial Sequence
  X-linked inhibitor of apoptosis (XIAP) siRNA
tgaacccaggaggcggaggttgt

SEQ ID NO: 16053 - DNA, 23 bp, Artificial Sequence
  X-linked inhibitor of apoptosis (XIAP) siRNA
gaacccaggaggcggaggttgtg

SEQ ID NO: 16054 - DNA, 23 bp, Artificial Sequence
  X-linked inhibitor of apoptosis (XIAP) siRNA
aacccaggaggcggaggttgtgg

SEQ ID NO: 16055 - DNA, 23 bp, Artificial Sequence
  X-linked inhibitor of apoptosis (XIAP) siRNA
acccaggaggcggaggttgtggt

SEQ ID NO: 16056 - DNA, 23 bp, Artificial Sequence
  X-linked inhibitor of apoptosis (XIAP) siRNA
cccaggaggcggaggttgtggtg

SEQ ID NO: 16057 - DNA, 23 bp, Artificial Sequence
  X-linked inhibitor of apoptosis (XIAP) siRNA
ccaggaggcggaggttgtggtga

SEQ ID NO: 16058 - DNA, 23 bp, Artificial Sequence
  X-linked inhibitor of apoptosis (XIAP) siRNA
caggaggcggaggttgtggtgag

SEQ ID NO: 16059 - DNA, 23 bp, Artificial Sequence
  X-linked inhibitor of apoptosis (XIAP) siRNA
aggaggcggaggttgtggtgagc

SEQ ID NO: 16060 - DNA, 23 bp, Artificial Sequence
  X-linked inhibitor of apoptosis (XIAP) siRNA
ggaggcggaggttgtggtgagcg

SEQ ID NO: 16061 - DNA, 23 bp, Artificial Sequence
  X-linked inhibitor of apoptosis (XIAP) siRNA
gaggcggaggttgtggtgagcga

SEQ ID NO: 16062 - DNA, 23 bp, Artificial Sequence
  X-linked inhibitor of apoptosis (XIAP) siRNA
aggcggaggttgtggtgagcgaa

SEQ ID NO: 16063 - DNA, 23 bp, Artificial Sequence
  X-linked inhibitor of apoptosis (XIAP) siRNA
ggcggaggttgtggtgagcgaag

SEQ ID NO: 16064 - DNA, 23 bp, Artificial Sequence
  X-linked inhibitor of apoptosis (XIAP) siRNA
gcggaggttgtggtgagcgaaga

SEQ ID NO: 16065 - DNA, 23 bp, Artificial Sequence
  X-linked inhibitor of apoptosis (XIAP) siRNA
cggaggttgtggtgagcgaagat

SEQ ID NO: 16066 - DNA, 23 bp, Artificial Sequence
  X-linked inhibitor of apoptosis (XIAP) siRNA
ggaggttgtggtgagcgaagatc

SEQ ID NO: 16067 - DNA, 23 bp, Artificial Sequence
  X-linked inhibitor of apoptosis (XIAP) siRNA
gaggttgtggtgagcgaagatcg

SEQ ID NO: 16068 - DNA, 23 bp, Artificial Sequence
  X-linked inhibitor of apoptosis (XIAP) siRNA
aggttgtggtgagcgaagatcgt

SEQ ID NO: 16069 - DNA, 23 bp, Artificial Sequence
  X-linked inhibitor of apoptosis (XIAP) siRNA
ggttgtggtgagcgaagatcgtg

SEQ ID NO: 16070 - DNA, 23 bp, Artificial Sequence
  X-linked inhibitor of apoptosis (XIAP) siRNA
gttgtggtgagcgaagatcgtgc

SEQ ID NO: 16071 - DNA, 23 bp, Artificial Sequence
  X-linked inhibitor of apoptosis (XIAP) siRNA
ttgtggtgagcgaagatcgtgcc

SEQ ID NO: 16072 - DNA, 23 bp, Artificial Sequence
  X-linked inhibitor of apoptosis (XIAP) siRNA
tgtggtgagcgaagatcgtgcca

SEQ ID NO: 16073 - DNA, 23 bp, Artificial Sequence
  X-linked inhibitor of apoptosis (XIAP) siRNA
gtggtgagcgaagatcgtgccat

SEQ ID NO: 16074 - DNA, 23 bp, Artificial Sequence
  X-linked inhibitor of apoptosis (XIAP) siRNA
tggtgagcgaagatcgtgccatt

SEQ ID NO: 16075 - DNA, 23 bp, Artificial Sequence
  X-linked inhibitor of apoptosis (XIAP) siRNA
ggtgagcgaagatcgtgccattg

SEQ ID NO: 16076 - DNA, 23 bp, Artificial Sequence
  X-linked inhibitor of apoptosis (XIAP) siRNA
gtgagcgaagatcgtgccattgc

SEQ ID NO: 16077 - DNA, 23 bp, Artificial Sequence
  X-linked inhibitor of apoptosis (XIAP) siRNA
tgagcgaagatcgtgccattgca

SEQ ID NO: 16078 - DNA, 23 bp, Artificial Sequence
  X-linked inhibitor of apoptosis (XIAP) siRNA
gagcgaagatcgtgccattgcac

SEQ ID NO: 16079 - DNA, 23 bp, Artificial Sequence
  X-linked inhibitor of apoptosis (XIAP) siRNA
agcgaagatcgtgccattgcact

SEQ ID NO: 16080 - DNA, 23 bp, Artificial Sequence
  X-linked inhibitor of apoptosis (XIAP) siRNA
gcgaagatcgtgccattgcactc

SEQ ID NO: 16081 - DNA, 23 bp, Artificial Sequence
  X-linked inhibitor of apoptosis (XIAP) siRNA
cgaagatcgtgccattgcactcc

SEQ ID NO: 16082 - DNA, 23 bp, Artificial Sequence
  X-linked inhibitor of apoptosis (XIAP) siRNA
gaagatcgtgccattgcactcca

SEQ ID NO: 16083 - DNA, 23 bp, Artificial Sequence
  X-linked inhibitor of apoptosis (XIAP) siRNA
aagatcgtgccattgcactccag

SEQ ID NO: 16084 - DNA, 23 bp, Artificial Sequence
  X-linked inhibitor of apoptosis (XIAP) siRNA
agatcgtgccattgcactccagc

SEQ ID NO: 16085 - DNA, 23 bp, Artificial Sequence
  X-linked inhibitor of apoptosis (XIAP) siRNA
gatcgtgccattgcactccagcc

SEQ ID NO: 16086 - DNA, 23 bp, Artificial Sequence
  X-linked inhibitor of apoptosis (XIAP) siRNA
atcgtgccattgcactccagcct

SEQ ID NO: 16087 - DNA, 23 bp, Artificial Sequence
  X-linked inhibitor of apoptosis (XIAP) siRNA
tcgtgccattgcactccagcctg

SEQ ID NO: 16088 - DNA, 23 bp, Artificial Sequence
  X-linked inhibitor of apoptosis (XIAP) siRNA
cgtgccattgcactccagcctgg

SEQ ID NO: 16089 - DNA, 23 bp, Artificial Sequence
  X-linked inhibitor of apoptosis (XIAP) siRNA
gtgccattgcactccagcctggg

SEQ ID NO: 16090 - DNA, 23 bp, Artificial Sequence
  X-linked inhibitor of apoptosis (XIAP) siRNA
tgccattgcactccagcctgggc

SEQ ID NO: 16091 - DNA, 23 bp, Artificial Sequence
  X-linked inhibitor of apoptosis (XIAP) siRNA
gccattgcactccagcctgggca

SEQ ID NO: 16092 - DNA, 23 bp, Artificial Sequence
  X-linked inhibitor of apoptosis (XIAP) siRNA
ccattgcactccagcctgggcaa

SEQ ID NO: 16093 - DNA, 23 bp, Artificial Sequence
  X-linked inhibitor of apoptosis (XIAP) siRNA
cattgcactccagcctgggcaac

SEQ ID NO: 16094 - DNA, 23 bp, Artificial Sequence
  X-linked inhibitor of apoptosis (XIAP) siRNA
attgcactccagcctgggcaaca

SEQ ID NO: 16095 - DNA, 23 bp, Artificial Sequence
  X-linked inhibitor of apoptosis (XIAP) siRNA
ttgcactccagcctgggcaacaa

SEQ ID NO: 16096 - DNA, 23 bp, Artificial Sequence
  X-linked inhibitor of apoptosis (XIAP) siRNA
tgcactccagcctgggcaacaag

SEQ ID NO: 16097 - DNA, 23 bp, Artificial Sequence
  X-linked inhibitor of apoptosis (XIAP) siRNA
gcactccagcctgggcaacaaga

SEQ ID NO: 16098 - DNA, 23 bp, Artificial Sequence
  X-linked inhibitor of apoptosis (XIAP) siRNA
cactccagcctgggcaacaagag

SEQ ID NO: 16099 - DNA, 23 bp, Artificial Sequence
  X-linked inhibitor of apoptosis (XIAP) siRNA
actccagcctgggcaacaagagc

SEQ ID NO: 16100 - DNA, 23 bp, Artificial Sequence
  X-linked inhibitor of apoptosis (XIAP) siRNA
ctccagcctgggcaacaagagca

SEQ ID NO: 16101 - DNA, 23 bp, Artificial Sequence
  X-linked inhibitor of apoptosis (XIAP) siRNA
tccagcctgggcaacaagagcaa

SEQ ID NO: 16102 - DNA, 23 bp, Artificial Sequence
  X-linked inhibitor of apoptosis (XIAP) siRNA
ccagcctgggcaacaagagcaaa

SEQ ID NO: 16103 - DNA, 23 bp, Artificial Sequence
  X-linked inhibitor of apoptosis (XIAP) siRNA
cagcctgggcaacaagagcaaaa

SEQ ID NO: 16104 - DNA, 23 bp, Artificial Sequence
  X-linked inhibitor of apoptosis (XIAP) siRNA
agcctgggcaacaagagcaaaac

SEQ ID NO: 16105 - DNA, 23 bp, Artificial Sequence
  X-linked inhibitor of apoptosis (XIAP) siRNA
gcctgggcaacaagagcaaaact

SEQ ID NO: 16106 - DNA, 23 bp, Artificial Sequence
  X-linked inhibitor of apoptosis (XIAP) siRNA
cctgggcaacaagagcaaaactc

SEQ ID NO: 16107 - DNA, 23 bp, Artificial Sequence
  X-linked inhibitor of apoptosis (XIAP) siRNA
ctgggcaacaagagcaaaactct

SEQ ID NO: 16108 - DNA, 23 bp, Artificial Sequence
  X-linked inhibitor of apoptosis (XIAP) siRNA
tgggcaacaagagcaaaactctg

SEQ ID NO: 16109 - DNA, 23 bp, Artificial Sequence
  X-linked inhibitor of apoptosis (XIAP) siRNA
gggcaacaagagcaaaactctgt

SEQ ID NO: 16110 - DNA, 23 bp, Artificial Sequence
  X-linked inhibitor of apoptosis (XIAP) siRNA
ggcaacaagagcaaaactctgtc

SEQ ID NO: 16111 - DNA, 23 bp, Artificial Sequence
  X-linked inhibitor of apoptosis (XIAP) siRNA
gcaacaagagcaaaactctgtct

SEQ ID NO: 16112 - DNA, 23 bp, Artificial Sequence
  X-linked inhibitor of apoptosis (XIAP) siRNA
caacaagagcaaaactctgtctc

SEQ ID NO: 16113 - DNA, 23 bp, Artificial Sequence
  X-linked inhibitor of apoptosis (XIAP) siRNA
aacaagagcaaaactctgtctca

SEQ ID NO: 16114 - DNA, 23 bp, Artificial Sequence
  X-linked inhibitor of apoptosis (XIAP) siRNA
acaagagcaaaactctgtctcaa

SEQ ID NO: 16115 - DNA, 23 bp, Artificial Sequence
  X-linked inhibitor of apoptosis (XIAP) siRNA
caagagcaaaactctgtctcaaa

SEQ ID NO: 16116 - DNA, 23 bp, Artificial Sequence
  X-linked inhibitor of apoptosis (XIAP) siRNA
aagagcaaaactctgtctcaaaa

SEQ ID NO: 16117 - DNA, 23 bp, Artificial Sequence
  X-linked inhibitor of apoptosis (XIAP) siRNA
agagcaaaactctgtctcaaaaa

SEQ ID NO: 16118 - DNA, 23 bp, Artificial Sequence
  X-linked inhibitor of apoptosis (XIAP) siRNA
gagcaaaactctgtctcaaaaaa

SEQ ID NO: 16119 - DNA, 23 bp, Artificial Sequence
  X-linked inhibitor of apoptosis (XIAP) siRNA
agcaaaactctgtctcaaaaaaa

SEQ ID NO: 16120 - DNA, 23 bp, Artificial Sequence
  X-linked inhibitor of apoptosis (XIAP) siRNA
gcaaaactctgtctcaaaaaaaa

SEQ ID NO: 16121 - DNA, 23 bp, Artificial Sequence
  X-linked inhibitor of apoptosis (XIAP) siRNA
aaaaaaaagatataaatcacaat

SEQ ID NO: 16122 - DNA, 23 bp, Artificial Sequence
  X-linked inhibitor of apoptosis (XIAP) siRNA
aaaaaaagatataaatcacaata

SEQ ID NO: 16123 - DNA, 23 bp, Artificial Sequence
  X-linked inhibitor of apoptosis (XIAP) siRNA
aaaaaagatataaatcacaataa

SEQ ID NO: 16124 - DNA, 23 bp, Artificial Sequence
  X-linked inhibitor of apoptosis (XIAP) siRNA
aaaaagatataaatcacaataaa

SEQ ID NO: 16125 - DNA, 23 bp, Artificial Sequence
  X-linked inhibitor of apoptosis (XIAP) siRNA
aaaagatataaatcacaataaat

SEQ ID NO: 16126 - DNA, 23 bp, Artificial Sequence
  X-linked inhibitor of apoptosis (XIAP) siRNA
aaagatataaatcacaataaata

SEQ ID NO: 16127 - DNA, 23 bp, Artificial Sequence
  X-linked inhibitor of apoptosis (XIAP) siRNA
aagatataaatcacaataaataa

SEQ ID NO: 16128 - DNA, 23 bp, Artificial Sequence
  X-linked inhibitor of apoptosis (XIAP) siRNA
agatataaatcacaataaataaa

SEQ ID NO: 16129 - DNA, 23 bp, Artificial Sequence
  X-linked inhibitor of apoptosis (XIAP) siRNA
gatataaatcacaataaataaat

SEQ ID NO: 16130 - DNA, 23 bp, Artificial Sequence
  X-linked inhibitor of apoptosis (XIAP) siRNA
atataaatcacaataaataaata

SEQ ID NO: 16131 - DNA, 23 bp, Artificial Sequence
  X-linked inhibitor of apoptosis (XIAP) siRNA
tataaatcacaataaataaatag

SEQ ID NO: 16132 - DNA, 23 bp, Artificial Sequence
  X-linked inhibitor of apoptosis (XIAP) siRNA
ataaatcacaataaataaatagg

SEQ ID NO: 16133 - DNA, 23 bp, Artificial Sequence
  X-linked inhibitor of apoptosis (XIAP) siRNA
taaatcacaataaataaataggt

SEQ ID NO: 16134 - DNA, 23 bp, Artificial Sequence
  X-linked inhibitor of apoptosis (XIAP) siRNA
aaatcacaataaataaataggtc

SEQ ID NO: 16135 - DNA, 23 bp, Artificial Sequence
  X-linked inhibitor of apoptosis (XIAP) siRNA
aatcacaataaataaataggtca

SEQ ID NO: 16136 - DNA, 23 bp, Artificial Sequence
  X-linked inhibitor of apoptosis (XIAP) siRNA
atcacaataaataaataggtcaa

SEQ ID NO: 16137 - DNA, 23 bp, Artificial Sequence
  X-linked inhibitor of apoptosis (XIAP) siRNA
tcacaataaataaataggtcaat

SEQ ID NO: 16138 - DNA, 23 bp, Artificial Sequence
  X-linked inhibitor of apoptosis (XIAP) siRNA
cacaataaataaataggtcaata

SEQ ID NO: 16139 - DNA, 23 bp, Artificial Sequence
  X-linked inhibitor of apoptosis (XIAP) siRNA
acaataaataaataggtcaatac

SEQ ID NO: 16140 - DNA, 23 bp, Artificial Sequence
  X-linked inhibitor of apoptosis (XIAP) siRNA
caataaataaataggtcaataca

SEQ ID NO: 16141 - DNA, 23 bp, Artificial Sequence
  X-linked inhibitor of apoptosis (XIAP) siRNA
aataaataaataggtcaatacaa

SEQ ID NO: 16142 - DNA, 23 bp, Artificial Sequence
  X-linked inhibitor of apoptosis (XIAP) siRNA
ataaataaataggtcaatacaaa

SEQ ID NO: 16143 - DNA, 23 bp, Artificial Sequence
  X-linked inhibitor of apoptosis (XIAP) siRNA
taaataaataggtcaatacaaat

SEQ ID NO: 16144 - DNA, 23 bp, Artificial Sequence
  X-linked inhibitor of apoptosis (XIAP) siRNA
aaataaataggtcaatacaaatg

SEQ ID NO: 16145 - DNA, 23 bp, Artificial Sequence
  X-linked inhibitor of apoptosis (XIAP) siRNA
aataaataggtcaatacaaatgt

SEQ ID NO: 16146 - DNA, 23 bp, Artificial Sequence
  X-linked inhibitor of apoptosis (XIAP) siRNA
ataaataggtcaatacaaatgtt

SEQ ID NO: 16147 - DNA, 23 bp, Artificial Sequence
  X-linked inhibitor of apoptosis (XIAP) siRNA
taaataggtcaatacaaatgtta

SEQ ID NO: 16148 - DNA, 23 bp, Artificial Sequence
  X-linked inhibitor of apoptosis (XIAP) siRNA
aaataggtcaatacaaatgttag

SEQ ID NO: 16149 - DNA, 23 bp, Artificial Sequence
  X-linked inhibitor of apoptosis (XIAP) siRNA
aataggtcaatacaaatgttagc

SEQ ID NO: 16150 - DNA, 23 bp, Artificial Sequence
  X-linked inhibitor of apoptosis (XIAP) siRNA
ataggtcaatacaaatgttagcc

SEQ ID NO: 16151 - DNA, 23 bp, Artificial Sequence
  X-linked inhibitor of apoptosis (XIAP) siRNA
taggtcaatacaaatgttagcca

SEQ ID NO: 16152 - DNA, 23 bp, Artificial Sequence
  X-linked inhibitor of apoptosis (XIAP) siRNA
aggtcaatacaaatgttagccag

SEQ ID NO: 16153 - DNA, 23 bp, Artificial Sequence
  X-linked inhibitor of apoptosis (XIAP) siRNA
ggtcaatacaaatgttagccagg

SEQ ID NO: 16154 - DNA, 23 bp, Artificial Sequence
  X-linked inhibitor of apoptosis (XIAP) siRNA
gtcaatacaaatgttagccaggc

SEQ ID NO: 16155 - DNA, 23 bp, Artificial Sequence
  X-linked inhibitor of apoptosis (XIAP) siRNA
tcaatacaaatgttagccaggcg

SEQ ID NO: 16156 - DNA, 23 bp, Artificial Sequence
  X-linked inhibitor of apoptosis (XIAP) siRNA
caatacaaatgttagccaggcgt

SEQ ID NO: 16157 - DNA, 23 bp, Artificial Sequence
  X-linked inhibitor of apoptosis (XIAP) siRNA
aatacaaatgttagccaggcgtg

SEQ ID NO: 16158 - DNA, 23 bp, Artificial Sequence
  X-linked inhibitor of apoptosis (XIAP) siRNA
atacaaatgttagccaggcgtgg

SEQ ID NO: 16159 - DNA, 23 bp, Artificial Sequence
  X-linked inhibitor of apoptosis (XIAP) siRNA
tacaaatgttagccaggcgtggt

SEQ ID NO: 16160 - DNA, 23 bp, Artificial Sequence
  X-linked inhibitor of apoptosis (XIAP) siRNA
acaaatgttagccaggcgtggtg

SEQ ID NO: 16161 - DNA, 23 bp, Artificial Sequence
  X-linked inhibitor of apoptosis (XIAP) siRNA
caaatgttagccaggcgtggtgg

SEQ ID NO: 16162 - DNA, 23 bp, Artificial Sequence
  X-linked inhibitor of apoptosis (XIAP) siRNA
aaatgttagccaggcgtggtggc

SEQ ID NO: 16163 - DNA, 23 bp, Artificial Sequence
  X-linked inhibitor of apoptosis (XIAP) siRNA
aatgttagccaggcgtggtggca

SEQ ID NO: 16164 - DNA, 23 bp, Artificial Sequence
  X-linked inhibitor of apoptosis (XIAP) siRNA
atgttagccaggcgtggtggcac

SEQ ID NO: 16165 - DNA, 23 bp, Artificial Sequence
  X-linked inhibitor of apoptosis (XIAP) siRNA
tgttagccaggcgtggtggcaca

SEQ ID NO: 16166 - DNA, 23 bp, Artificial Sequence
  X-linked inhibitor of apoptosis (XIAP) siRNA
gttagccaggcgtggtggcacat

SEQ ID NO: 16167 - DNA, 23 bp, Artificial Sequence
  X-linked inhibitor of apoptosis (XIAP) siRNA
ttagccaggcgtggtggcacatg

SEQ ID NO: 16168 - DNA, 23 bp, Artificial Sequence
  X-linked inhibitor of apoptosis (XIAP) siRNA
tagccaggcgtggtggcacatgc

SEQ ID NO: 16169 - DNA, 23 bp, Artificial Sequence
  X-linked inhibitor of apoptosis (XIAP) siRNA
agccaggcgtggtggcacatgcc

SEQ ID NO: 16170 - DNA, 23 bp, Artificial Sequence
  X-linked inhibitor of apoptosis (XIAP) siRNA
gccaggcgtggtggcacatgccc

SEQ ID NO: 16171 - DNA, 23 bp, Artificial Sequence
  X-linked inhibitor of apoptosis (XIAP) siRNA
ccaggcgtggtggcacatgccca

SEQ ID NO: 16172 - DNA, 23 bp, Artificial Sequence
  X-linked inhibitor of apoptosis (XIAP) siRNA
caggcgtggtggcacatgcccat

SEQ ID NO: 16173 - DNA, 23 bp, Artificial Sequence
  X-linked inhibitor of apoptosis (XIAP) siRNA
aggcgtggtggcacatgcccata

SEQ ID NO: 16174 - DNA, 23 bp, Artificial Sequence
  X-linked inhibitor of apoptosis (XIAP) siRNA
ggcgtggtggcacatgcccatag

SEQ ID NO: 16175 - DNA, 23 bp, Artificial Sequence
  X-linked inhibitor of apoptosis (XIAP) siRNA
gcgtggtggcacatgcccatagt

SEQ ID NO: 16176 - DNA, 23 bp, Artificial Sequence
  X-linked inhibitor of apoptosis (XIAP) siRNA
cgtggtggcacatgcccatagtc

SEQ ID NO: 16177 - DNA, 23 bp, Artificial Sequence
  X-linked inhibitor of apoptosis (XIAP) siRNA
gtggtggcacatgcccatagtcg

SEQ ID NO: 16178 - DNA, 23 bp, Artificial Sequence
  X-linked inhibitor of apoptosis (XIAP) siRNA
tggtggcacatgcccatagtcgc

SEQ ID NO: 16179 - DNA, 23 bp, Artificial Sequence
  X-linked inhibitor of apoptosis (XIAP) siRNA
ggtggcacatgcccatagtcgca

SEQ ID NO: 16180 - DNA, 23 bp, Artificial Sequence
  X-linked inhibitor of apoptosis (XIAP) siRNA
gtggcacatgcccatagtcgcag

SEQ ID NO: 16181 - DNA, 23 bp, Artificial Sequence
  X-linked inhibitor of apoptosis (XIAP) siRNA
tggcacatgcccatagtcgcagc

SEQ ID NO: 16182 - DNA, 23 bp, Artificial Sequence
  X-linked inhibitor of apoptosis (XIAP) siRNA
ggcacatgcccatagtcgcagct

SEQ ID NO: 16183 - DNA, 23 bp, Artificial Sequence
  X-linked inhibitor of apoptosis (XIAP) siRNA
gcacatgcccatagtcgcagcta

SEQ ID NO: 16184 - DNA, 23 bp, Artificial Sequence
  X-linked inhibitor of apoptosis (XIAP) siRNA
cacatgcccatagtcgcagctac

SEQ ID NO: 16185 - DNA, 23 bp, Artificial Sequence
  X-linked inhibitor of apoptosis (XIAP) siRNA
acatgcccatagtcgcagctact

SEQ ID NO: 16186 - DNA, 23 bp, Artificial Sequence
  X-linked inhibitor of apoptosis (XIAP) siRNA
catgcccatagtcgcagctactc

SEQ ID NO: 16187 - DNA, 23 bp, Artificial Sequence
  X-linked inhibitor of apoptosis (XIAP) siRNA
atgcccatagtcgcagctactct

SEQ ID NO: 16188 - DNA, 23 bp, Artificial Sequence
  X-linked inhibitor of apoptosis (XIAP) siRNA
tgcccatagtcgcagctactctg

SEQ ID NO: 16189 - DNA, 23 bp, Artificial Sequence
  X-linked inhibitor of apoptosis (XIAP) siRNA
gcccatagtcgcagctactctgg

SEQ ID NO: 16190 - DNA, 23 bp, Artificial Sequence
  X-linked inhibitor of apoptosis (XIAP) siRNA
cccatagtcgcagctactctgga

SEQ ID NO: 16191 - DNA, 23 bp, Artificial Sequence
  X-linked inhibitor of apoptosis (XIAP) siRNA
ccatagtcgcagctactctggag

SEQ ID NO: 16192 - DNA, 23 bp, Artificial Sequence
  X-linked inhibitor of apoptosis (XIAP) siRNA
catagtcgcagctactctggagg

SEQ ID NO: 16193 - DNA, 23 bp, Artificial Sequence
  X-linked inhibitor of apoptosis (XIAP) siRNA
atagtcgcagctactctggaggc

SEQ ID NO: 16194 - DNA, 23 bp, Artificial Sequence
  X-linked inhibitor of apoptosis (XIAP) siRNA
tagtcgcagctactctggaggca

SEQ ID NO: 16195 - DNA, 23 bp, Artificial Sequence
  X-linked inhibitor of apoptosis (XIAP) siRNA
agtcgcagctactctggaggcag

SEQ ID NO: 16196 - DNA, 23 bp, Artificial Sequence
  X-linked inhibitor of apoptosis (XIAP) siRNA
gtcgcagctactctggaggcaga

SEQ ID NO: 16197 - DNA, 23 bp, Artificial Sequence
  X-linked inhibitor of apoptosis (XIAP) siRNA
tcgcagctactctggaggcagag

SEQ ID NO: 16198 - DNA, 23 bp, Artificial Sequence
  X-linked inhibitor of apoptosis (XIAP) siRNA
cgcagctactctggaggcagagg

SEQ ID NO: 16199 - DNA, 23 bp, Artificial Sequence
  X-linked inhibitor of apoptosis (XIAP) siRNA
gcagctactctggaggcagaggc

SEQ ID NO: 16200 - DNA, 23 bp, Artificial Sequence
  X-linked inhibitor of apoptosis (XIAP) siRNA
cagctactctggaggcagaggca

SEQ ID NO: 16201 - DNA, 23 bp, Artificial Sequence
  X-linked inhibitor of apoptosis (XIAP) siRNA
agctactctggaggcagaggcag

SEQ ID NO: 16202 - DNA, 23 bp, Artificial Sequence
  X-linked inhibitor of apoptosis (XIAP) siRNA
gctactctggaggcagaggcagg

SEQ ID NO: 16203 - DNA, 23 bp, Artificial Sequence
  X-linked inhibitor of apoptosis (XIAP) siRNA
ctactctggaggcagaggcagga

SEQ ID NO: 16204 - DNA, 23 bp, Artificial Sequence
  X-linked inhibitor of apoptosis (XIAP) siRNA
tactctggaggcagaggcaggag

SEQ ID NO: 16205 - DNA, 23 bp, Artificial Sequence
  X-linked inhibitor of apoptosis (XIAP) siRNA
actctggaggcagaggcaggagg

SEQ ID NO: 16206 - DNA, 23 bp, Artificial Sequence
  X-linked inhibitor of apoptosis (XIAP) siRNA
ctctggaggcagaggcaggagga

SEQ ID NO: 16207 - DNA, 23 bp, Artificial Sequence
  X-linked inhibitor of apoptosis (XIAP) siRNA
tctggaggcagaggcaggaggat

SEQ ID NO: 16208 - DNA, 23 bp, Artificial Sequence
  X-linked inhibitor of apoptosis (XIAP) siRNA
ctggaggcagaggcaggaggatc

SEQ ID NO: 16209 - DNA, 23 bp, Artificial Sequence
  X-linked inhibitor of apoptosis (XIAP) siRNA
tggaggcagaggcaggaggatca

SEQ ID NO: 16210 - DNA, 23 bp, Artificial Sequence
  X-linked inhibitor of apoptosis (XIAP) siRNA
ggaggcagaggcaggaggatcac

SEQ ID NO: 16211 - DNA, 23 bp, Artificial Sequence
  X-linked inhibitor of apoptosis (XIAP) siRNA
gaggcagaggcaggaggatcact

SEQ ID NO: 16212 - DNA, 23 bp, Artificial Sequence
  X-linked inhibitor of apoptosis (XIAP) siRNA
aggcagaggcaggaggatcactt

SEQ ID NO: 16213 - DNA, 23 bp, Artificial Sequence
  X-linked inhibitor of apoptosis (XIAP) siRNA
ggcagaggcaggaggatcacttg

SEQ ID NO: 16214 - DNA, 23 bp, Artificial Sequence
  X-linked inhibitor of apoptosis (XIAP) siRNA
gcagaggcaggaggatcacttga

SEQ ID NO: 16215 - DNA, 23 bp, Artificial Sequence
  X-linked inhibitor of apoptosis (XIAP) siRNA
cagaggcaggaggatcacttgag

SEQ ID NO: 16216 - DNA, 23 bp, Artificial Sequence
  X-linked inhibitor of apoptosis (XIAP) siRNA
agaggcaggaggatcacttgagc

SEQ ID NO: 16217 - DNA, 23 bp, Artificial Sequence
  X-linked inhibitor of apoptosis (XIAP) siRNA
gaggcaggaggatcacttgagcc

SEQ ID NO: 16218 - DNA, 23 bp, Artificial Sequence
  X-linked inhibitor of apoptosis (XIAP) siRNA
aggcaggaggatcacttgagccc

SEQ ID NO: 16219 - DNA, 23 bp, Artificial Sequence
  X-linked inhibitor of apoptosis (XIAP) siRNA
ggcaggaggatcacttgagccca

SEQ ID NO: 16220 - DNA, 23 bp, Artificial Sequence
  X-linked inhibitor of apoptosis (XIAP) siRNA
gcaggaggatcacttgagcccat

SEQ ID NO: 16221 - DNA, 23 bp, Artificial Sequence
  X-linked inhibitor of apoptosis (XIAP) siRNA
caggaggatcacttgagcccatg

SEQ ID NO: 16222 - DNA, 23 bp, Artificial Sequence
  X-linked inhibitor of apoptosis (XIAP) siRNA
aggaggatcacttgagcccatga

SEQ ID NO: 16223 - DNA, 23 bp, Artificial Sequence
  X-linked inhibitor of apoptosis (XIAP) siRNA
ggaggatcacttgagcccatgaa

SEQ ID NO: 16224 - DNA, 23 bp, Artificial Sequence
  X-linked inhibitor of apoptosis (XIAP) siRNA
gaggatcacttgagcccatgaat

SEQ ID NO: 16225 - DNA, 23 bp, Artificial Sequence
  X-linked inhibitor of apoptosis (XIAP) siRNA
aggatcacttgagcccatgaatt

SEQ ID NO: 16226 - DNA, 23 bp, Artificial Sequence
  X-linked inhibitor of apoptosis (XIAP) siRNA
ggatcacttgagcccatgaattt

SEQ ID NO: 16227 - DNA, 23 bp, Artificial Sequence
  X-linked inhibitor of apoptosis (XIAP) siRNA
gatcacttgagcccatgaatttg

SEQ ID NO: 16228 - DNA, 23 bp, Artificial Sequence
  X-linked inhibitor of apoptosis (XIAP) siRNA
atcacttgagcccatgaatttga

SEQ ID NO: 16229 - DNA, 23 bp, Artificial Sequence
  X-linked inhibitor of apoptosis (XIAP) siRNA
tcacttgagcccatgaatttgag

SEQ ID NO: 16230 - DNA, 23 bp, Artificial Sequence
  X-linked inhibitor of apoptosis (XIAP) siRNA
cacttgagcccatgaatttgagg

SEQ ID NO: 16231 - DNA, 23 bp, Artificial Sequence
  X-linked inhibitor of apoptosis (XIAP) siRNA
acttgagcccatgaatttgaggc

SEQ ID NO: 16232 - DNA, 23 bp, Artificial Sequence
  X-linked inhibitor of apoptosis (XIAP) siRNA
cttgagcccatgaatttgaggca

SEQ ID NO: 16233 - DNA, 23 bp, Artificial Sequence
  X-linked inhibitor of apoptosis (XIAP) siRNA
ttgagcccatgaatttgaggcag

SEQ ID NO: 16234 - DNA, 23 bp, Artificial Sequence
  X-linked inhibitor of apoptosis (XIAP) siRNA
tgagcccatgaatttgaggcagc

SEQ ID NO: 16235 - DNA, 23 bp, Artificial Sequence
  X-linked inhibitor of apoptosis (XIAP) siRNA
gagcccatgaatttgaggcagca

SEQ ID NO: 16236 - DNA, 23 bp, Artificial Sequence
  X-linked inhibitor of apoptosis (XIAP) siRNA
agcccatgaatttgaggcagcag

SEQ ID NO: 16237 - DNA, 23 bp, Artificial Sequence
  X-linked inhibitor of apoptosis (XIAP) siRNA
gcccatgaatttgaggcagcagt

SEQ ID NO: 16238 - DNA, 23 bp, Artificial Sequence
  X-linked inhibitor of apoptosis (XIAP) siRNA
cccatgaatttgaggcagcagtg

SEQ ID NO: 16239 - DNA, 23 bp, Artificial Sequence
  X-linked inhibitor of apoptosis (XIAP) siRNA
ccatgaatttgaggcagcagtga

SEQ ID NO: 16240 - DNA, 23 bp, Artificial Sequence
  X-linked inhibitor of apoptosis (XIAP) siRNA
catgaatttgaggcagcagtgag

SEQ ID NO: 16241 - DNA, 23 bp, Artificial Sequence
  X-linked inhibitor of apoptosis (XIAP) siRNA
atgaatttgaggcagcagtgagc

SEQ ID NO: 16242 - DNA, 23 bp, Artificial Sequence
  X-linked inhibitor of apoptosis (XIAP) siRNA
tgaatttgaggcagcagtgagct

SEQ ID NO: 16243 - DNA, 23 bp, Artificial Sequence
  X-linked inhibitor of apoptosis (XIAP) siRNA
gaatttgaggcagcagtgagcta

SEQ ID NO: 16244 - DNA, 23 bp, Artificial Sequence
  X-linked inhibitor of apoptosis (XIAP) siRNA
aatttgaggcagcagtgagctat

SEQ ID NO: 16245 - DNA, 23 bp, Artificial Sequence
  X-linked inhibitor of apoptosis (XIAP) siRNA
atttgaggcagcagtgagctatg

SEQ ID NO: 16246 - DNA, 23 bp, Artificial Sequence
  X-linked inhibitor of apoptosis (XIAP) siRNA
tttgaggcagcagtgagctatga

SEQ ID NO: 16247 - DNA, 23 bp, Artificial Sequence
  X-linked inhibitor of apoptosis (XIAP) siRNA
ttgaggcagcagtgagctatgat

SEQ ID NO: 16248 - DNA, 23 bp, Artificial Sequence
  X-linked inhibitor of apoptosis (XIAP) siRNA
tgaggcagcagtgagctatgatt

SEQ ID NO: 16249 - DNA, 23 bp, Artificial Sequence
  X-linked inhibitor of apoptosis (XIAP) siRNA
gaggcagcagtgagctatgattg

SEQ ID NO: 16250 - DNA, 23 bp, Artificial Sequence
  X-linked inhibitor of apoptosis (XIAP) siRNA
aggcagcagtgagctatgattgt

SEQ ID NO: 16251 - DNA, 23 bp, Artificial Sequence
  X-linked inhibitor of apoptosis (XIAP) siRNA
ggcagcagtgagctatgattgtg

SEQ ID NO: 16252 - DNA, 23 bp, Artificial Sequence
  X-linked inhibitor of apoptosis (XIAP) siRNA
gcagcagtgagctatgattgtgc

SEQ ID NO: 16253 - DNA, 23 bp, Artificial Sequence
  X-linked inhibitor of apoptosis (XIAP) siRNA
cagcagtgagctatgattgtgcc

SEQ ID NO: 16254 - DNA, 23 bp, Artificial Sequence
  X-linked inhibitor of apoptosis (XIAP) siRNA
agcagtgagctatgattgtgcca

SEQ ID NO: 16255 - DNA, 23 bp, Artificial Sequence
  X-linked inhibitor of apoptosis (XIAP) siRNA
gcagtgagctatgattgtgccac

SEQ ID NO: 16256 - DNA, 23 bp, Artificial Sequence
  X-linked inhibitor of apoptosis (XIAP) siRNA
cagtgagctatgattgtgccact

SEQ ID NO: 16257 - DNA, 23 bp, Artificial Sequence
  X-linked inhibitor of apoptosis (XIAP) siRNA
agtgagctatgattgtgccactg

SEQ ID NO: 16258 - DNA, 23 bp, Artificial Sequence
  X-linked inhibitor of apoptosis (XIAP) siRNA
gtgagctatgattgtgccactgt

SEQ ID NO: 16259 - DNA, 23 bp, Artificial Sequence
  X-linked inhibitor of apoptosis (XIAP) siRNA
tgagctatgattgtgccactgta

SEQ ID NO: 16260 - DNA, 23 bp, Artificial Sequence
  X-linked inhibitor of apoptosis (XIAP) siRNA
gagctatgattgtgccactgtac

SEQ ID NO: 16261 - DNA, 23 bp, Artificial Sequence
  X-linked inhibitor of apoptosis (XIAP) siRNA
agctatgattgtgccactgtact

SEQ ID NO: 16262 - DNA, 23 bp, Artificial Sequence
  X-linked inhibitor of apoptosis (XIAP) siRNA
gctatgattgtgccactgtactc

SEQ ID NO: 16263 - DNA, 23 bp, Artificial Sequence
  X-linked inhibitor of apoptosis (XIAP) siRNA
ctatgattgtgccactgtactcc

SEQ ID NO: 16264 - DNA, 23 bp, Artificial Sequence
  X-linked inhibitor of apoptosis (XIAP) siRNA
tatgattgtgccactgtactcca

SEQ ID NO: 16265 - DNA, 23 bp, Artificial Sequence
  X-linked inhibitor of apoptosis (XIAP) siRNA
atgattgtgccactgtactccag

SEQ ID NO: 16266 - DNA, 23 bp, Artificial Sequence
  X-linked inhibitor of apoptosis (XIAP) siRNA
tgattgtgccactgtactccagt

SEQ ID NO: 16267 - DNA, 23 bp, Artificial Sequence
  X-linked inhibitor of apoptosis (XIAP) siRNA
gattgtgccactgtactccagtc

SEQ ID NO: 16268 - DNA, 23 bp, Artificial Sequence
  X-linked inhibitor of apoptosis (XIAP) siRNA
attgtgccactgtactccagtct

SEQ ID NO: 16269 - DNA, 23 bp, Artificial Sequence
  X-linked inhibitor of apoptosis (XIAP) siRNA
ttgtgccactgtactccagtctg

SEQ ID NO: 16270 - DNA, 23 bp, Artificial Sequence
  X-linked inhibitor of apoptosis (XIAP) siRNA
tgtgccactgtactccagtctgg

SEQ ID NO: 16271 - DNA, 23 bp, Artificial Sequence
  X-linked inhibitor of apoptosis (XIAP) siRNA
gtgccactgtactccagtctggg

SEQ ID NO: 16272 - DNA, 23 bp, Artificial Sequence
  X-linked inhibitor of apoptosis (XIAP) siRNA
tgccactgtactccagtctgggt

SEQ ID NO: 16273 - DNA, 23 bp, Artificial Sequence
  X-linked inhibitor of apoptosis (XIAP) siRNA
gccactgtactccagtctgggtg

SEQ ID NO: 16274 - DNA, 23 bp, Artificial Sequence
  X-linked inhibitor of apoptosis (XIAP) siRNA
ccactgtactccagtctgggtga

SEQ ID NO: 16275 - DNA, 23 bp, Artificial Sequence
  X-linked inhibitor of apoptosis (XIAP) siRNA
cactgtactccagtctgggtgac

SEQ ID NO: 16276 - DNA, 23 bp, Artificial Sequence
  X-linked inhibitor of apoptosis (XIAP) siRNA
actgtactccagtctgggtgaca

SEQ ID NO: 16277 - DNA, 23 bp, Artificial Sequence
  X-linked inhibitor of apoptosis (XIAP) siRNA
ctgtactccagtctgggtgacag

SEQ ID NO: 16278 - DNA, 23 bp, Artificial Sequence
  X-linked inhibitor of apoptosis (XIAP) siRNA
tgtactccagtctgggtgacaga

SEQ ID NO: 16279 - DNA, 23 bp, Artificial Sequence
  X-linked inhibitor of apoptosis (XIAP) siRNA
gtactccagtctgggtgacagag

SEQ ID NO: 16280 - DNA, 23 bp, Artificial Sequence
  X-linked inhibitor of apoptosis (XIAP) siRNA
tactccagtctgggtgacagagt

SEQ ID NO: 16281 - DNA, 23 bp, Artificial Sequence
  X-linked inhibitor of apoptosis (XIAP) siRNA
actccagtctgggtgacagagtg

SEQ ID NO: 16282 - DNA, 23 bp, Artificial Sequence
  X-linked inhibitor of apoptosis (XIAP) siRNA
ctccagtctgggtgacagagtga

SEQ ID NO: 16283 - DNA, 23 bp, Artificial Sequence
  X-linked inhibitor of apoptosis (XIAP) siRNA
tccagtctgggtgacagagtgag

SEQ ID NO: 16284 - DNA, 23 bp, Artificial Sequence
  X-linked inhibitor of apoptosis (XIAP) siRNA
ccagtctgggtgacagagtgaga

SEQ ID NO: 16285 - DNA, 23 bp, Artificial Sequence
  X-linked inhibitor of apoptosis (XIAP) siRNA
cagtctgggtgacagagtgagac

SEQ ID NO: 16286 - DNA, 23 bp, Artificial Sequence
  X-linked inhibitor of apoptosis (XIAP) siRNA
agtctgggtgacagagtgagacc

SEQ ID NO: 16287 - DNA, 23 bp, Artificial Sequence
  X-linked inhibitor of apoptosis (XIAP) siRNA
gtctgggtgacagagtgagaccc

SEQ ID NO: 16288 - DNA, 23 bp, Artificial Sequence
  X-linked inhibitor of apoptosis (XIAP) siRNA
tctgggtgacagagtgagacccc

SEQ ID NO: 16289 - DNA, 23 bp, Artificial Sequence
  X-linked inhibitor of apoptosis (XIAP) siRNA
ctgggtgacagagtgagacccca

SEQ ID NO: 16290 - DNA, 23 bp, Artificial Sequence
  X-linked inhibitor of apoptosis (XIAP) siRNA
tgggtgacagagtgagaccccat

SEQ ID NO: 16291 - DNA, 23 bp, Artificial Sequence
  X-linked inhibitor of apoptosis (XIAP) siRNA
gggtgacagagtgagaccccatc

SEQ ID NO: 16292 - DNA, 23 bp, Artificial Sequence
  X-linked inhibitor of apoptosis (XIAP) siRNA
ggtgacagagtgagaccccatct

SEQ ID NO: 16293 - DNA, 23 bp, Artificial Sequence
  X-linked inhibitor of apoptosis (XIAP) siRNA
gtgacagagtgagaccccatctc

SEQ ID NO: 16294 - DNA, 23 bp, Artificial Sequence
  X-linked inhibitor of apoptosis (XIAP) siRNA
tgacagagtgagaccccatctct

SEQ ID NO: 16295 - DNA, 23 bp, Artificial Sequence
  X-linked inhibitor of apoptosis (XIAP) siRNA
gacagagtgagaccccatctcta

SEQ ID NO: 16296 - DNA, 23 bp, Artificial Sequence
  X-linked inhibitor of apoptosis (XIAP) siRNA
acagagtgagaccccatctctaa

SEQ ID NO: 16297 - DNA, 23 bp, Artificial Sequence
  X-linked inhibitor of apoptosis (XIAP) siRNA
cagagtgagaccccatctctaaa

SEQ ID NO: 16298 - DNA, 23 bp, Artificial Sequence
  X-linked inhibitor of apoptosis (XIAP) siRNA
agagtgagaccccatctctaaat

SEQ ID NO: 16299 - DNA, 23 bp, Artificial Sequence
  X-linked inhibitor of apoptosis (XIAP) siRNA
gagtgagaccccatctctaaata

SEQ ID NO: 16300 - DNA, 23 bp, Artificial Sequence
  X-linked inhibitor of apoptosis (XIAP) siRNA
agtgagaccccatctctaaataa

SEQ ID NO: 16301 - DNA, 23 bp, Artificial Sequence
  X-linked inhibitor of apoptosis (XIAP) siRNA
gtgagaccccatctctaaataaa

SEQ ID NO: 16302 - DNA, 23 bp, Artificial Sequence
  X-linked inhibitor of apoptosis (XIAP) siRNA
tgagaccccatctctaaataaat

SEQ ID NO: 16303 - DNA, 23 bp, Artificial Sequence
  X-linked inhibitor of apoptosis (XIAP) siRNA
gagaccccatctctaaataaata

SEQ ID NO: 16304 - DNA, 23 bp, Artificial Sequence
  X-linked inhibitor of apoptosis (XIAP) siRNA
agaccccatctctaaataaatag

SEQ ID NO: 16305 - DNA, 23 bp, Artificial Sequence
  X-linked inhibitor of apoptosis (XIAP) siRNA
gaccccatctctaaataaatagg

SEQ ID NO: 16306 - DNA, 23 bp, Artificial Sequence
  X-linked inhibitor of apoptosis (XIAP) siRNA
accccatctctaaataaataggt

SEQ ID NO: 16307 - DNA, 23 bp, Artificial Sequence
  X-linked inhibitor of apoptosis (XIAP) siRNA
ccccatctctaaataaataggtc

SEQ ID NO: 16308 - DNA, 23 bp, Artificial Sequence
  X-linked inhibitor of apoptosis (XIAP) siRNA
cccatctctaaataaataggtca

SEQ ID NO: 16309 - DNA, 23 bp, Artificial Sequence
  X-linked inhibitor of apoptosis (XIAP) siRNA
ccatctctaaataaataggtcaa

SEQ ID NO: 16310 - DNA, 23 bp, Artificial Sequence
  X-linked inhibitor of apoptosis (XIAP) siRNA
catctctaaataaataggtcaaa

SEQ ID NO: 16311 - DNA, 23 bp, Artificial Sequence
  X-linked inhibitor of apoptosis (XIAP) siRNA
atctctaaataaataggtcaaac

SEQ ID NO: 16312 - DNA, 23 bp, Artificial Sequence
  X-linked inhibitor of apoptosis (XIAP) siRNA
tctctaaataaataggtcaaacc

SEQ ID NO: 16313 - DNA, 23 bp, Artificial Sequence
  X-linked inhibitor of apoptosis (XIAP) siRNA
ctctaaataaataggtcaaaccc

SEQ ID NO: 16314 - DNA, 23 bp, Artificial Sequence
  X-linked inhibitor of apoptosis (XIAP) siRNA
tctaaataaataggtcaaaccct

SEQ ID NO: 16315 - DNA, 23 bp, Artificial Sequence
  X-linked inhibitor of apoptosis (XIAP) siRNA
ctaaataaataggtcaaaccctt

SEQ ID NO: 16316 - DNA, 23 bp, Artificial Sequence
  X-linked inhibitor of apoptosis (XIAP) siRNA
taaataaataggtcaaaccctta

SEQ ID NO: 16317 - DNA, 23 bp, Artificial Sequence
  X-linked inhibitor of apoptosis (XIAP) siRNA
aaataaataggtcaaacccttaa

SEQ ID NO: 16318 - DNA, 23 bp, Artificial Sequence
  X-linked inhibitor of apoptosis (XIAP) siRNA
aataaataggtcaaacccttaaa

SEQ ID NO: 16319 - DNA, 23 bp, Artificial Sequence
  X-linked inhibitor of apoptosis (XIAP) siRNA
ataaataggtcaaacccttaaaa

SEQ ID NO: 16320 - DNA, 23 bp, Artificial Sequence
  X-linked inhibitor of apoptosis (XIAP) siRNA
taaataggtcaaacccttaaaaa

SEQ ID NO: 16321 - DNA, 23 bp, Artificial Sequence
  X-linked inhibitor of apoptosis (XIAP) siRNA
aaataggtcaaacccttaaaaat

SEQ ID NO: 16322 - DNA, 23 bp, Artificial Sequence
  X-linked inhibitor of apoptosis (XIAP) siRNA
aataggtcaaacccttaaaaata

SEQ ID NO: 16323 - DNA, 23 bp, Artificial Sequence
  X-linked inhibitor of apoptosis (XIAP) siRNA
ataggtcaaacccttaaaaatat

SEQ ID NO: 16324 - DNA, 23 bp, Artificial Sequence
  X-linked inhibitor of apoptosis (XIAP) siRNA
taggtcaaacccttaaaaatatt

SEQ ID NO: 16325 - DNA, 23 bp, Artificial Sequence
  X-linked inhibitor of apoptosis (XIAP) siRNA
aggtcaaacccttaaaaatattt

SEQ ID NO: 16326 - DNA, 23 bp, Artificial Sequence
  X-linked inhibitor of apoptosis (XIAP) siRNA
ggtcaaacccttaaaaatattta

SEQ ID NO: 16327 - DNA, 23 bp, Artificial Sequence
  X-linked inhibitor of apoptosis (XIAP) siRNA
gtcaaacccttaaaaatatttaa

SEQ ID NO: 16328 - DNA, 23 bp, Artificial Sequence
  X-linked inhibitor of apoptosis (XIAP) siRNA
tcaaacccttaaaaatatttaaa

SEQ ID NO: 16329 - DNA, 23 bp, Artificial Sequence
  X-linked inhibitor of apoptosis (XIAP) siRNA
caaacccttaaaaatatttaaat

SEQ ID NO: 16330 - DNA, 23 bp, Artificial Sequence
  X-linked inhibitor of apoptosis (XIAP) siRNA
aaacccttaaaaatatttaaatt

SEQ ID NO: 16331 - DNA, 23 bp, Artificial Sequence
  X-linked inhibitor of apoptosis (XIAP) siRNA
aacccttaaaaatatttaaattc

SEQ ID NO: 16332 - DNA, 23 bp, Artificial Sequence
  X-linked inhibitor of apoptosis (XIAP) siRNA
acccttaaaaatatttaaattct

SEQ ID NO: 16333 - DNA, 23 bp, Artificial Sequence
  X-linked inhibitor of apoptosis (XIAP) siRNA
cccttaaaaatatttaaattctt

SEQ ID NO: 16334 - DNA, 23 bp, Artificial Sequence
  X-linked inhibitor of apoptosis (XIAP) siRNA
ccttaaaaatatttaaattctta

SEQ ID NO: 16335 - DNA, 23 bp, Artificial Sequence
  X-linked inhibitor of apoptosis (XIAP) siRNA
cttaaaaatatttaaattcttaa

SEQ ID NO: 16336 - DNA, 23 bp, Artificial Sequence
  X-linked inhibitor of apoptosis (XIAP) siRNA
ttaaaaatatttaaattcttaaa

SEQ ID NO: 16337 - DNA, 23 bp, Artificial Sequence
  X-linked inhibitor of apoptosis (XIAP) siRNA
taaaaatatttaaattcttaaaa

SEQ ID NO: 16338 - DNA, 23 bp, Artificial Sequence
  X-linked inhibitor of apoptosis (XIAP) siRNA
aaaaatatttaaattcttaaaaa

SEQ ID NO: 16339 - DNA, 23 bp, Artificial Sequence
  X-linked inhibitor of apoptosis (XIAP) siRNA
aaaatatttaaattcttaaaaaa

SEQ ID NO: 16340 - DNA, 23 bp, Artificial Sequence
  X-linked inhibitor of apoptosis (XIAP) siRNA
aaatatttaaattcttaaaaaat

SEQ ID NO: 16341 - DNA, 23 bp, Artificial Sequence
  X-linked inhibitor of apoptosis (XIAP) siRNA
aatatttaaattcttaaaaaatt

SEQ ID NO: 16342 - DNA, 23 bp, Artificial Sequence
  X-linked inhibitor of apoptosis (XIAP) siRNA
atatttaaattcttaaaaaattg

SEQ ID NO: 16343 - DNA, 23 bp, Artificial Sequence
  X-linked inhibitor of apoptosis (XIAP) siRNA
tatttaaattcttaaaaaattga

SEQ ID NO: 16344 - DNA, 23 bp, Artificial Sequence
  X-linked inhibitor of apoptosis (XIAP) siRNA
atttaaattcttaaaaaattgaa

SEQ ID NO: 16345 - DNA, 23 bp, Artificial Sequence
  X-linked inhibitor of apoptosis (XIAP) siRNA
tttaaattcttaaaaaattgaaa

SEQ ID NO: 16346 - DNA, 23 bp, Artificial Sequence
  X-linked inhibitor of apoptosis (XIAP) siRNA
ttaaattcttaaaaaattgaaaa

SEQ ID NO: 16347 - DNA, 23 bp, Artificial Sequence
  X-linked inhibitor of apoptosis (XIAP) siRNA
taaattcttaaaaaattgaaaag

SEQ ID NO: 16348 - DNA, 23 bp, Artificial Sequence
  X-linked inhibitor of apoptosis (XIAP) siRNA
aaattcttaaaaaattgaaaaga

SEQ ID NO: 16349 - DNA, 23 bp, Artificial Sequence
  X-linked inhibitor of apoptosis (XIAP) siRNA
aattcttaaaaaattgaaaagat

SEQ ID NO: 16350 - DNA, 23 bp, Artificial Sequence
  X-linked inhibitor of apoptosis (XIAP) siRNA
attcttaaaaaattgaaaagatt

SEQ ID NO: 16351 - DNA, 23 bp, Artificial Sequence
  X-linked inhibitor of apoptosis (XIAP) siRNA
ttcttaaaaaattgaaaagatta

SEQ ID NO: 16352 - DNA, 23 bp, Artificial Sequence
  X-linked inhibitor of apoptosis (XIAP) siRNA
tcttaaaaaattgaaaagattat

SEQ ID NO: 16353 - DNA, 23 bp, Artificial Sequence
  X-linked inhibitor of apoptosis (XIAP) siRNA
cttaaaaaattgaaaagattatt

SEQ ID NO: 16354 - DNA, 23 bp, Artificial Sequence
  X-linked inhibitor of apoptosis (XIAP) siRNA
ttaaaaaattgaaaagattattc

SEQ ID NO: 16355 - DNA, 23 bp, Artificial Sequence
  X-linked inhibitor of apoptosis (XIAP) siRNA
taaaaaattgaaaagattattct

SEQ ID NO: 16356 - DNA, 23 bp, Artificial Sequence
  X-linked inhibitor of apoptosis (XIAP) siRNA
aaaaaattgaaaagattattctt

SEQ ID NO: 16357 - DNA, 23 bp, Artificial Sequence
  X-linked inhibitor of apoptosis (XIAP) siRNA
aaaaattgaaaagattattcttc

SEQ ID NO: 16358 - DNA, 23 bp, Artificial Sequence
  X-linked inhibitor of apoptosis (XIAP) siRNA
aaaattgaaaagattattcttct

SEQ ID NO: 16359 - DNA, 23 bp, Artificial Sequence
  X-linked inhibitor of apoptosis (XIAP) siRNA
aaattgaaaagattattcttctc

SEQ ID NO: 16360 - DNA, 23 bp, Artificial Sequence
  X-linked inhibitor of apoptosis (XIAP) siRNA
aattgaaaagattattcttctca

SEQ ID NO: 16361 - DNA, 23 bp, Artificial Sequence
  X-linked inhibitor of apoptosis (XIAP) siRNA
attgaaaagattattcttctcaa

SEQ ID NO: 16362 - DNA, 23 bp, Artificial Sequence
  X-linked inhibitor of apoptosis (XIAP) siRNA
ttgaaaagattattcttctcaaa

SEQ ID NO: 16363 - DNA, 23 bp, Artificial Sequence
  X-linked inhibitor of apoptosis (XIAP) siRNA
tgaaaagattattcttctcaaat

SEQ ID NO: 16364 - DNA, 23 bp, Artificial Sequence
  X-linked inhibitor of apoptosis (XIAP) siRNA
gaaaagattattcttctcaaatt

SEQ ID NO: 16365 - DNA, 23 bp, Artificial Sequence
  X-linked inhibitor of apoptosis (XIAP) siRNA
aaaagattattcttctcaaattt

SEQ ID NO: 16366 - DNA, 23 bp, Artificial Sequence
  X-linked inhibitor of apoptosis (XIAP) siRNA
aaagattattcttctcaaattta

SEQ ID NO: 16367 - DNA, 23 bp, Artificial Sequence
  X-linked inhibitor of apoptosis (XIAP) siRNA
aagattattcttctcaaatttag

SEQ ID NO: 16368 - DNA, 23 bp, Artificial Sequence
  X-linked inhibitor of apoptosis (XIAP) siRNA
agattattcttctcaaatttagt

SEQ ID NO: 16369 - DNA, 23 bp, Artificial Sequence
  X-linked inhibitor of apoptosis (XIAP) siRNA
gattattcttctcaaatttagtt

SEQ ID NO: 16370 - DNA, 23 bp, Artificial Sequence
  X-linked inhibitor of apoptosis (XIAP) siRNA
attattcttctcaaatttagttg

SEQ ID NO: 16371 - DNA, 23 bp, Artificial Sequence
  X-linked inhibitor of apoptosis (XIAP) siRNA
ttattcttctcaaatttagttga

SEQ ID NO: 16372 - DNA, 23 bp, Artificial Sequence
  X-linked inhibitor of apoptosis (XIAP) siRNA
tattcttctcaaatttagttgag

SEQ ID NO: 16373 - DNA, 23 bp, Artificial Sequence
  X-linked inhibitor of apoptosis (XIAP) siRNA
attcttctcaaatttagttgagc

SEQ ID NO: 16374 - DNA, 23 bp, Artificial Sequence
  X-linked inhibitor of apoptosis (XIAP) siRNA
ttcttctcaaatttagttgagct

SEQ ID NO: 16375 - DNA, 23 bp, Artificial Sequence
  X-linked inhibitor of apoptosis (XIAP) siRNA
tcttctcaaatttagttgagctt

SEQ ID NO: 16376 - DNA, 23 bp, Artificial Sequence
  X-linked inhibitor of apoptosis (XIAP) siRNA
cttctcaaatttagttgagcttt

SEQ ID NO: 16377 - DNA, 23 bp, Artificial Sequence
  X-linked inhibitor of apoptosis (XIAP) siRNA
ttctcaaatttagttgagctttc

SEQ ID NO: 16378 - DNA, 23 bp, Artificial Sequence
  X-linked inhibitor of apoptosis (XIAP) siRNA
tctcaaatttagttgagctttct

SEQ ID NO: 16379 - DNA, 23 bp, Artificial Sequence
  X-linked inhibitor of apoptosis (XIAP) siRNA
ctcaaatttagttgagctttcta

SEQ ID NO: 16380 - DNA, 23 bp, Artificial Sequence
  X-linked inhibitor of apoptosis (XIAP) siRNA
tcaaatttagttgagctttctaa

SEQ ID NO: 16381 - DNA, 23 bp, Artificial Sequence
  X-linked inhibitor of apoptosis (XIAP) siRNA
caaatttagttgagctttctaag

SEQ ID NO: 16382 - DNA, 23 bp, Artificial Sequence
  X-linked inhibitor of apoptosis (XIAP) siRNA
aaatttagttgagctttctaaga

SEQ ID NO: 16383 - DNA, 23 bp, Artificial Sequence
  X-linked inhibitor of apoptosis (XIAP) siRNA
aatttagttgagctttctaagag

SEQ ID NO: 16384 - DNA, 23 bp, Artificial Sequence
  X-linked inhibitor of apoptosis (XIAP) siRNA
atttagttgagctttctaagaga

SEQ ID NO: 16385 - DNA, 23 bp, Artificial Sequence
  X-linked inhibitor of apoptosis (XIAP) siRNA
tttagttgagctttctaagagaa

SEQ ID NO: 16386 - DNA, 23 bp, Artificial Sequence
  X-linked inhibitor of apoptosis (XIAP) siRNA
ttagttgagctttctaagagaag

SEQ ID NO: 16387 - DNA, 23 bp, Artificial Sequence
  X-linked inhibitor of apoptosis (XIAP) siRNA
tagttgagctttctaagagaagc

SEQ ID NO: 16388 - DNA, 23 bp, Artificial Sequence
  X-linked inhibitor of apoptosis (XIAP) siRNA
agttgagctttctaagagaagca

SEQ ID NO: 16389 - DNA, 23 bp, Artificial Sequence
  X-linked inhibitor of apoptosis (XIAP) siRNA
gttgagctttctaagagaagcaa

SEQ ID NO: 16390 - DNA, 23 bp, Artificial Sequence
  X-linked inhibitor of apoptosis (XIAP) siRNA
ttgagctttctaagagaagcaat

SEQ ID NO: 16391 - DNA, 23 bp, Artificial Sequence
  X-linked inhibitor of apoptosis (XIAP) siRNA
tgagctttctaagagaagcaatt

SEQ ID NO: 16392 - DNA, 23 bp, Artificial Sequence
  X-linked inhibitor of apoptosis (XIAP) siRNA
gagctttctaagagaagcaattg

SEQ ID NO: 16393 - DNA, 23 bp, Artificial Sequence
  X-linked inhibitor of apoptosis (XIAP) siRNA
agctttctaagagaagcaattgg

SEQ ID NO: 16394 - DNA, 23 bp, Artificial Sequence
  X-linked inhibitor of apoptosis (XIAP) siRNA
gctttctaagagaagcaattggc

SEQ ID NO: 16395 - DNA, 23 bp, Artificial Sequence
  X-linked inhibitor of apoptosis (XIAP) siRNA
ctttctaagagaagcaattggct

SEQ ID NO: 16396 - DNA, 23 bp, Artificial Sequence
  X-linked inhibitor of apoptosis (XIAP) siRNA
tttctaagagaagcaattggctt

SEQ ID NO: 16397 - DNA, 23 bp, Artificial Sequence
  X-linked inhibitor of apoptosis (XIAP) siRNA
ttctaagagaagcaattggcttt

SEQ ID NO: 16398 - DNA, 23 bp, Artificial Sequence
  X-linked inhibitor of apoptosis (XIAP) siRNA
tctaagagaagcaattggctttt

SEQ ID NO: 16399 - DNA, 23 bp, Artificial Sequence
  X-linked inhibitor of apoptosis (XIAP) siRNA
ctaagagaagcaattggcttttt

SEQ ID NO: 16400 - DNA, 23 bp, Artificial Sequence
  X-linked inhibitor of apoptosis (XIAP) siRNA
taagagaagcaattggctttttc

SEQ ID NO: 16401 - DNA, 23 bp, Artificial Sequence
  X-linked inhibitor of apoptosis (XIAP) siRNA
aagagaagcaattggctttttcc

SEQ ID NO: 16402 - DNA, 23 bp, Artificial Sequence
  X-linked inhibitor of apoptosis (XIAP) siRNA
agagaagcaattggctttttccc

SEQ ID NO: 16403 - DNA, 23 bp, Artificial Sequence
  X-linked inhibitor of apoptosis (XIAP) siRNA
gagaagcaattggctttttccca

SEQ ID NO: 16404 - DNA, 23 bp, Artificial Sequence
  X-linked inhibitor of apoptosis (XIAP) siRNA
agaagcaattggctttttcccac

SEQ ID NO: 16405 - DNA, 23 bp, Artificial Sequence
  X-linked inhibitor of apoptosis (XIAP) siRNA
gaagcaattggctttttcccact

SEQ ID NO: 16406 - DNA, 23 bp, Artificial Sequence
  X-linked inhibitor of apoptosis (XIAP) siRNA
aagcaattggctttttcccactt

SEQ ID NO: 16407 - DNA, 23 bp, Artificial Sequence
  X-linked inhibitor of apoptosis (XIAP) siRNA
agcaattggctttttcccacttc

SEQ ID NO: 16408 - DNA, 23 bp, Artificial Sequence
  X-linked inhibitor of apoptosis (XIAP) siRNA
gcaattggctttttcccacttca

SEQ ID NO: 16409 - DNA, 23 bp, Artificial Sequence
  X-linked inhibitor of apoptosis (XIAP) siRNA
caattggctttttcccacttcaa

SEQ ID NO: 16410 - DNA, 23 bp, Artificial Sequence
  X-linked inhibitor of apoptosis (XIAP) siRNA
aattggctttttcccacttcaat

SEQ ID NO: 16411 - DNA, 23 bp, Artificial Sequence
  X-linked inhibitor of apoptosis (XIAP) siRNA
attggctttttcccacttcaata

SEQ ID NO: 16412 - DNA, 23 bp, Artificial Sequence
  X-linked inhibitor of apoptosis (XIAP) siRNA
ttggctttttcccacttcaataa

SEQ ID NO: 16413 - DNA, 23 bp, Artificial Sequence
  X-linked inhibitor of apoptosis (XIAP) siRNA
tggctttttcccacttcaataat

SEQ ID NO: 16414 - DNA, 23 bp, Artificial Sequence
  X-linked inhibitor of apoptosis (XIAP) siRNA
ggctttttcccacttcaataatc

SEQ ID NO: 16415 - DNA, 23 bp, Artificial Sequence
  X-linked inhibitor of apoptosis (XIAP) siRNA
gctttttcccacttcaataatca

SEQ ID NO: 16416 - DNA, 23 bp, Artificial Sequence
  X-linked inhibitor of apoptosis (XIAP) siRNA
ctttttcccacttcaataatcat

SEQ ID NO: 16417 - DNA, 23 bp, Artificial Sequence
  X-linked inhibitor of apoptosis (XIAP) siRNA
tttttcccacttcaataatcatt

SEQ ID NO: 16418 - DNA, 23 bp, Artificial Sequence
  X-linked inhibitor of apoptosis (XIAP) siRNA
ttttcccacttcaataatcattt

SEQ ID NO: 16419 - DNA, 23 bp, Artificial Sequence
  X-linked inhibitor of apoptosis (XIAP) siRNA
tttcccacttcaataatcatttt

SEQ ID NO: 16420 - DNA, 23 bp, Artificial Sequence
  X-linked inhibitor of apoptosis (XIAP) siRNA
ttcccacttcaataatcattttc

SEQ ID NO: 16421 - DNA, 23 bp, Artificial Sequence
  X-linked inhibitor of apoptosis (XIAP) siRNA
tcccacttcaataatcattttca

SEQ ID NO: 16422 - DNA, 23 bp, Artificial Sequence
  X-linked inhibitor of apoptosis (XIAP) siRNA
cccacttcaataatcattttcag

SEQ ID NO: 16423 - DNA, 23 bp, Artificial Sequence
  X-linked inhibitor of apoptosis (XIAP) siRNA
ccacttcaataatcattttcagt

SEQ ID NO: 16424 - DNA, 23 bp, Artificial Sequence
  X-linked inhibitor of apoptosis (XIAP) siRNA
cacttcaataatcattttcagtt

SEQ ID NO: 16425 - DNA, 23 bp, Artificial Sequence
  X-linked inhibitor of apoptosis (XIAP) siRNA
acttcaataatcattttcagttt

SEQ ID NO: 16426 - DNA, 23 bp, Artificial Sequence
  X-linked inhibitor of apoptosis (XIAP) siRNA
cttcaataatcattttcagtttg

SEQ ID NO: 16427 - DNA, 23 bp, Artificial Sequence
  X-linked inhibitor of apoptosis (XIAP) siRNA
ttcaataatcattttcagtttga

SEQ ID NO: 16428 - DNA, 23 bp, Artificial Sequence
  X-linked inhibitor of apoptosis (XIAP) siRNA
tcaataatcattttcagtttgac

SEQ ID NO: 16429 - DNA, 23 bp, Artificial Sequence
  X-linked inhibitor of apoptosis (XIAP) siRNA
caataatcattttcagtttgact

SEQ ID NO: 16430 - DNA, 23 bp, Artificial Sequence
  X-linked inhibitor of apoptosis (XIAP) siRNA
aataatcattttcagtttgactc

SEQ ID NO: 16431 - DNA, 23 bp, Artificial Sequence
  X-linked inhibitor of apoptosis (XIAP) siRNA
ataatcattttcagtttgactca

SEQ ID NO: 16432 - DNA, 23 bp, Artificial Sequence
  X-linked inhibitor of apoptosis (XIAP) siRNA
taatcattttcagtttgactcat

SEQ ID NO: 16433 - DNA, 23 bp, Artificial Sequence
  X-linked inhibitor of apoptosis (XIAP) siRNA
aatcattttcagtttgactcata

SEQ ID NO: 16434 - DNA, 23 bp, Artificial Sequence
  X-linked inhibitor of apoptosis (XIAP) siRNA
atcattttcagtttgactcatac

SEQ ID NO: 16435 - DNA, 23 bp, Artificial Sequence
  X-linked inhibitor of apoptosis (XIAP) siRNA
tcattttcagtttgactcataca

SEQ ID NO: 16436 - DNA, 23 bp, Artificial Sequence
  X-linked inhibitor of apoptosis (XIAP) siRNA
cattttcagtttgactcatacag

SEQ ID NO: 16437 - DNA, 23 bp, Artificial Sequence
  X-linked inhibitor of apoptosis (XIAP) siRNA
attttcagtttgactcatacagt

SEQ ID NO: 16438 - DNA, 23 bp, Artificial Sequence
  X-linked inhibitor of apoptosis (XIAP) siRNA
ttttcagtttgactcatacagtt

SEQ ID NO: 16439 - DNA, 23 bp, Artificial Sequence
  X-linked inhibitor of apoptosis (XIAP) siRNA
tttcagtttgactcatacagtta

SEQ ID NO: 16440 - DNA, 23 bp, Artificial Sequence
  X-linked inhibitor of apoptosis (XIAP) siRNA
ttcagtttgactcatacagttaa

SEQ ID NO: 16441 - DNA, 23 bp, Artificial Sequence
  X-linked inhibitor of apoptosis (XIAP) siRNA
tcagtttgactcatacagttaac

SEQ ID NO: 16442 - DNA, 23 bp, Artificial Sequence
  X-linked inhibitor of apoptosis (XIAP) siRNA
cagtttgactcatacagttaaca

SEQ ID NO: 16443 - DNA, 23 bp, Artificial Sequence
  X-linked inhibitor of apoptosis (XIAP) siRNA
agtttgactcatacagttaacac

SEQ ID NO: 16444 - DNA, 23 bp, Artificial Sequence
  X-linked inhibitor of apoptosis (XIAP) siRNA
gtttgactcatacagttaacaca

SEQ ID NO: 16445 - DNA, 23 bp, Artificial Sequence
  X-linked inhibitor of apoptosis (XIAP) siRNA
tttgactcatacagttaacacaa

SEQ ID NO: 16446 - DNA, 23 bp, Artificial Sequence
  X-linked inhibitor of apoptosis (XIAP) siRNA
ttgactcatacagttaacacaat

SEQ ID NO: 16447 - DNA, 23 bp, Artificial Sequence
  X-linked inhibitor of apoptosis (XIAP) siRNA
tgactcatacagttaacacaatg

SEQ ID NO: 16448 - DNA, 23 bp, Artificial Sequence
  X-linked inhibitor of apoptosis (XIAP) siRNA
gactcatacagttaacacaatgt

SEQ ID NO: 16449 - DNA, 23 bp, Artificial Sequence
  X-linked inhibitor of apoptosis (XIAP) siRNA
actcatacagttaacacaatgtg

SEQ ID NO: 16450 - DNA, 23 bp, Artificial Sequence
  X-linked inhibitor of apoptosis (XIAP) siRNA
ctcatacagttaacacaatgtga

SEQ ID NO: 16451 - DNA, 23 bp, Artificial Sequence
  X-linked inhibitor of apoptosis (XIAP) siRNA
tcatacagttaacacaatgtgaa

SEQ ID NO: 16452 - DNA, 23 bp, Artificial Sequence
  X-linked inhibitor of apoptosis (XIAP) siRNA
catacagttaacacaatgtgaat

SEQ ID NO: 16453 - DNA, 23 bp, Artificial Sequence
  X-linked inhibitor of apoptosis (XIAP) siRNA
atacagttaacacaatgtgaatt

SEQ ID NO: 16454 - DNA, 23 bp, Artificial Sequence
  X-linked inhibitor of apoptosis (XIAP) siRNA
tacagttaacacaatgtgaattt

SEQ ID NO: 16455 - DNA, 23 bp, Artificial Sequence
  X-linked inhibitor of apoptosis (XIAP) siRNA
acagttaacacaatgtgaatttc

SEQ ID NO: 16456 - DNA, 23 bp, Artificial Sequence
  X-linked inhibitor of apoptosis (XIAP) siRNA
cagttaacacaatgtgaatttct

SEQ ID NO: 16457 - DNA, 23 bp, Artificial Sequence
  X-linked inhibitor of apoptosis (XIAP) siRNA
agttaacacaatgtgaatttctt

SEQ ID NO: 16458 - DNA, 23 bp, Artificial Sequence
  X-linked inhibitor of apoptosis (XIAP) siRNA
gttaacacaatgtgaatttcttc

SEQ ID NO: 16459 - DNA, 23 bp, Artificial Sequence
  X-linked inhibitor of apoptosis (XIAP) siRNA
ttaacacaatgtgaatttcttcc

SEQ ID NO: 16460 - DNA, 23 bp, Artificial Sequence
  X-linked inhibitor of apoptosis (XIAP) siRNA
taacacaatgtgaatttcttcct

SEQ ID NO: 16461 - DNA, 23 bp, Artificial Sequence
  X-linked inhibitor of apoptosis (XIAP) siRNA
aacacaatgtgaatttcttcctc

SEQ ID NO: 16462 - DNA, 23 bp, Artificial Sequence
  X-linked inhibitor of apoptosis (XIAP) siRNA
acacaatgtgaatttcttcctca

SEQ ID NO: 16463 - DNA, 23 bp, Artificial Sequence
  X-linked inhibitor of apoptosis (XIAP) siRNA
cacaatgtgaatttcttcctcag

SEQ ID NO: 16464 - DNA, 23 bp, Artificial Sequence
  X-linked inhibitor of apoptosis (XIAP) siRNA
acaatgtgaatttcttcctcagc

SEQ ID NO: 16465 - DNA, 23 bp, Artificial Sequence
  X-linked inhibitor of apoptosis (XIAP) siRNA
caatgtgaatttcttcctcagca

SEQ ID NO: 16466 - DNA, 23 bp, Artificial Sequence
  X-linked inhibitor of apoptosis (XIAP) siRNA
aatgtgaatttcttcctcagcat

SEQ ID NO: 16467 - DNA, 23 bp, Artificial Sequence
  X-linked inhibitor of apoptosis (XIAP) siRNA
atgtgaatttcttcctcagcata

SEQ ID NO: 16468 - DNA, 23 bp, Artificial Sequence
  X-linked inhibitor of apoptosis (XIAP) siRNA
tgtgaatttcttcctcagcataa

SEQ ID NO: 16469 - DNA, 23 bp, Artificial Sequence
  X-linked inhibitor of apoptosis (XIAP) siRNA
gtgaatttcttcctcagcataac

SEQ ID NO: 16470 - DNA, 23 bp, Artificial Sequence
  X-linked inhibitor of apoptosis (XIAP) siRNA
tgaatttcttcctcagcataaca

SEQ ID NO: 16471 - DNA, 23 bp, Artificial Sequence
  X-linked inhibitor of apoptosis (XIAP) siRNA
gaatttcttcctcagcataacag

SEQ ID NO: 16472 - DNA, 23 bp, Artificial Sequence
  X-linked inhibitor of apoptosis (XIAP) siRNA
aatttcttcctcagcataacaga

SEQ ID NO: 16473 - DNA, 23 bp, Artificial Sequence
  X-linked inhibitor of apoptosis (XIAP) siRNA
atttcttcctcagcataacagag

SEQ ID NO: 16474 - DNA, 23 bp, Artificial Sequence
  X-linked inhibitor of apoptosis (XIAP) siRNA
tttcttcctcagcataacagagt

SEQ ID NO: 16475 - DNA, 23 bp, Artificial Sequence
  X-linked inhibitor of apoptosis (XIAP) siRNA
ttcttcctcagcataacagagtt

SEQ ID NO: 16476 - DNA, 23 bp, Artificial Sequence
  X-linked inhibitor of apoptosis (XIAP) siRNA
tcttcctcagcataacagagtta

SEQ ID NO: 16477 - DNA, 23 bp, Artificial Sequence
  X-linked inhibitor of apoptosis (XIAP) siRNA
cttcctcagcataacagagttat

SEQ ID NO: 16478 - DNA, 23 bp, Artificial Sequence
  X-linked inhibitor of apoptosis (XIAP) siRNA
ttcctcagcataacagagttata

SEQ ID NO: 16479 - DNA, 23 bp, Artificial Sequence
  X-linked inhibitor of apoptosis (XIAP) siRNA
tcctcagcataacagagttatag

SEQ ID NO: 16480 - DNA, 23 bp, Artificial Sequence
  X-linked inhibitor of apoptosis (XIAP) siRNA
cctcagcataacagagttataga

SEQ ID NO: 16481 - DNA, 23 bp, Artificial Sequence
  X-linked inhibitor of apoptosis (XIAP) siRNA
ctcagcataacagagttatagaa

SEQ ID NO: 16482 - DNA, 23 bp, Artificial Sequence
  X-linked inhibitor of apoptosis (XIAP) siRNA
tcagcataacagagttatagaat

SEQ ID NO: 16483 - DNA, 23 bp, Artificial Sequence
  X-linked inhibitor of apoptosis (XIAP) siRNA
cagcataacagagttatagaatg

SEQ ID NO: 16484 - DNA, 23 bp, Artificial Sequence
  X-linked inhibitor of apoptosis (XIAP) siRNA
agcataacagagttatagaatga

SEQ ID NO: 16485 - DNA, 23 bp, Artificial Sequence
  X-linked inhibitor of apoptosis (XIAP) siRNA
gcataacagagttatagaatgac

SEQ ID NO: 16486 - DNA, 23 bp, Artificial Sequence
  X-linked inhibitor of apoptosis (XIAP) siRNA
cataacagagttatagaatgaca

SEQ ID NO: 16487 - DNA, 23 bp, Artificial Sequence
  X-linked inhibitor of apoptosis (XIAP) siRNA
ataacagagttatagaatgacag

SEQ ID NO: 16488 - DNA, 23 bp, Artificial Sequence
  X-linked inhibitor of apoptosis (XIAP) siRNA
taacagagttatagaatgacagg

SEQ ID NO: 16489 - DNA, 23 bp, Artificial Sequence
  X-linked inhibitor of apoptosis (XIAP) siRNA
aacagagttatagaatgacaggg

SEQ ID NO: 16490 - DNA, 23 bp, Artificial Sequence
  X-linked inhibitor of apoptosis (XIAP) siRNA
acagagttatagaatgacagggc

SEQ ID NO: 16491 - DNA, 23 bp, Artificial Sequence
  X-linked inhibitor of apoptosis (XIAP) siRNA
cagagttatagaatgacagggct

SEQ ID NO: 16492 - DNA, 23 bp, Artificial Sequence
  X-linked inhibitor of apoptosis (XIAP) siRNA
agagttatagaatgacagggctg

SEQ ID NO: 16493 - DNA, 23 bp, Artificial Sequence
  X-linked inhibitor of apoptosis (XIAP) siRNA
gagttatagaatgacagggctgg

SEQ ID NO: 16494 - DNA, 23 bp, Artificial Sequence
  X-linked inhibitor of apoptosis (XIAP) siRNA
agttatagaatgacagggctgga

SEQ ID NO: 16495 - DNA, 23 bp, Artificial Sequence
  X-linked inhibitor of apoptosis (XIAP) siRNA
gttatagaatgacagggctggaa

SEQ ID NO: 16496 - DNA, 23 bp, Artificial Sequence
  X-linked inhibitor of apoptosis (XIAP) siRNA
ttatagaatgacagggctggaag

SEQ ID NO: 16497 - DNA, 23 bp, Artificial Sequence
  X-linked inhibitor of apoptosis (XIAP) siRNA
tatagaatgacagggctggaagt

SEQ ID NO: 16498 - DNA, 23 bp, Artificial Sequence
  X-linked inhibitor of apoptosis (XIAP) siRNA
atagaatgacagggctggaagtg

SEQ ID NO: 16499 - DNA, 23 bp, Artificial Sequence
  X-linked inhibitor of apoptosis (XIAP) siRNA
tagaatgacagggctggaagtga

SEQ ID NO: 16500 - DNA, 23 bp, Artificial Sequence
  X-linked inhibitor of apoptosis (XIAP) siRNA
agaatgacagggctggaagtgac

SEQ ID NO: 16501 - DNA, 23 bp, Artificial Sequence
  X-linked inhibitor of apoptosis (XIAP) siRNA
gaatgacagggctggaagtgacc

SEQ ID NO: 16502 - DNA, 23 bp, Artificial Sequence
  X-linked inhibitor of apoptosis (XIAP) siRNA
aatgacagggctggaagtgacct

SEQ ID NO: 16503 - DNA, 23 bp, Artificial Sequence
  X-linked inhibitor of apoptosis (XIAP) siRNA
atgacagggctggaagtgacctt

SEQ ID NO: 16504 - DNA, 23 bp, Artificial Sequence
  X-linked inhibitor of apoptosis (XIAP) siRNA
tgacagggctggaagtgacctta

SEQ ID NO: 16505 - DNA, 23 bp, Artificial Sequence
  X-linked inhibitor of apoptosis (XIAP) siRNA
gacagggctggaagtgaccttag

SEQ ID NO: 16506 - DNA, 23 bp, Artificial Sequence
  X-linked inhibitor of apoptosis (XIAP) siRNA
acagggctggaagtgaccttaga

SEQ ID NO: 16507 - DNA, 23 bp, Artificial Sequence
  X-linked inhibitor of apoptosis (XIAP) siRNA
cagggctggaagtgaccttagag

SEQ ID NO: 16508 - DNA, 23 bp, Artificial Sequence
  X-linked inhibitor of apoptosis (XIAP) siRNA
agggctggaagtgaccttagaga

SEQ ID NO: 16509 - DNA, 23 bp, Artificial Sequence
  X-linked inhibitor of apoptosis (XIAP) siRNA
gggctggaagtgaccttagagag

SEQ ID NO: 16510 - DNA, 23 bp, Artificial Sequence
  X-linked inhibitor of apoptosis (XIAP) siRNA
ggctggaagtgaccttagagagt

SEQ ID NO: 16511 - DNA, 23 bp, Artificial Sequence
  X-linked inhibitor of apoptosis (XIAP) siRNA
gctggaagtgaccttagagagta

SEQ ID NO: 16512 - DNA, 23 bp, Artificial Sequence
  X-linked inhibitor of apoptosis (XIAP) siRNA
ctggaagtgaccttagagagtat

SEQ ID NO: 16513 - DNA, 23 bp, Artificial Sequence
  X-linked inhibitor of apoptosis (XIAP) siRNA
tggaagtgaccttagagagtatc

SEQ ID NO: 16514 - DNA, 23 bp, Artificial Sequence
  X-linked inhibitor of apoptosis (XIAP) siRNA
ggaagtgaccttagagagtatcc

SEQ ID NO: 16515 - DNA, 23 bp, Artificial Sequence
  X-linked inhibitor of apoptosis (XIAP) siRNA
gaagtgaccttagagagtatcca

SEQ ID NO: 16516 - DNA, 23 bp, Artificial Sequence
  X-linked inhibitor of apoptosis (XIAP) siRNA
aagtgaccttagagagtatccag

SEQ ID NO: 16517 - DNA, 23 bp, Artificial Sequence
  X-linked inhibitor of apoptosis (XIAP) siRNA
agtgaccttagagagtatccagt

SEQ ID NO: 16518 - DNA, 23 bp, Artificial Sequence
  X-linked inhibitor of apoptosis (XIAP) siRNA
gtgaccttagagagtatccagtt

SEQ ID NO: 16519 - DNA, 23 bp, Artificial Sequence
  X-linked inhibitor of apoptosis (XIAP) siRNA
tgaccttagagagtatccagttc

SEQ ID NO: 16520 - DNA, 23 bp, Artificial Sequence
  X-linked inhibitor of apoptosis (XIAP) siRNA
gaccttagagagtatccagttct

SEQ ID NO: 16521 - DNA, 23 bp, Artificial Sequence
  X-linked inhibitor of apoptosis (XIAP) siRNA
accttagagagtatccagttctt

SEQ ID NO: 16522 - DNA, 23 bp, Artificial Sequence
  X-linked inhibitor of apoptosis (XIAP) siRNA
ccttagagagtatccagttcttt

SEQ ID NO: 16523 - DNA, 23 bp, Artificial Sequence
  X-linked inhibitor of apoptosis (XIAP) siRNA
cttagagagtatccagttctttc

SEQ ID NO: 16524 - DNA, 23 bp, Artificial Sequence
  X-linked inhibitor of apoptosis (XIAP) siRNA
ttagagagtatccagttctttca

SEQ ID NO: 16525 - DNA, 23 bp, Artificial Sequence
  X-linked inhibitor of apoptosis (XIAP) siRNA
tagagagtatccagttctttcat

SEQ ID NO: 16526 - DNA, 23 bp, Artificial Sequence
  X-linked inhibitor of apoptosis (XIAP) siRNA
agagagtatccagttctttcatt

SEQ ID NO: 16527 - DNA, 23 bp, Artificial Sequence
  X-linked inhibitor of apoptosis (XIAP) siRNA
gagagtatccagttctttcattt

SEQ ID NO: 16528 - DNA, 23 bp, Artificial Sequence
  X-linked inhibitor of apoptosis (XIAP) siRNA
agagtatccagttctttcatttt

SEQ ID NO: 16529 - DNA, 23 bp, Artificial Sequence
  X-linked inhibitor of apoptosis (XIAP) siRNA
gagtatccagttctttcatttta

SEQ ID NO: 16530 - DNA, 23 bp, Artificial Sequence
  X-linked inhibitor of apoptosis (XIAP) siRNA
agtatccagttctttcattttac

SEQ ID NO: 16531 - DNA, 23 bp, Artificial Sequence
  X-linked inhibitor of apoptosis (XIAP) siRNA
gtatccagttctttcattttaca

SEQ ID NO: 16532 - DNA, 23 bp, Artificial Sequence
  X-linked inhibitor of apoptosis (XIAP) siRNA
tatccagttctttcattttacag

SEQ ID NO: 16533 - DNA, 23 bp, Artificial Sequence
  X-linked inhibitor of apoptosis (XIAP) siRNA
atccagttctttcattttacagg

SEQ ID NO: 16534 - DNA, 23 bp, Artificial Sequence
  X-linked inhibitor of apoptosis (XIAP) siRNA
tccagttctttcattttacaggt

SEQ ID NO: 16535 - DNA, 23 bp, Artificial Sequence
  X-linked inhibitor of apoptosis (XIAP) siRNA
ccagttctttcattttacaggtg

SEQ ID NO: 16536 - DNA, 23 bp, Artificial Sequence
  X-linked inhibitor of apoptosis (XIAP) siRNA
cagttctttcattttacaggtga

SEQ ID NO: 16537 - DNA, 23 bp, Artificial Sequence
  X-linked inhibitor of apoptosis (XIAP) siRNA
agttctttcattttacaggtgag

SEQ ID NO: 16538 - DNA, 23 bp, Artificial Sequence
  X-linked inhibitor of apoptosis (XIAP) siRNA
gttctttcattttacaggtgagg

SEQ ID NO: 16539 - DNA, 23 bp, Artificial Sequence
  X-linked inhibitor of apoptosis (XIAP) siRNA
ttctttcattttacaggtgaggc

SEQ ID NO: 16540 - DNA, 23 bp, Artificial Sequence
  X-linked inhibitor of apoptosis (XIAP) siRNA
tctttcattttacaggtgaggca

SEQ ID NO: 16541 - DNA, 23 bp, Artificial Sequence
  X-linked inhibitor of apoptosis (XIAP) siRNA
ctttcattttacaggtgaggcaa

SEQ ID NO: 16542 - DNA, 23 bp, Artificial Sequence
  X-linked inhibitor of apoptosis (XIAP) siRNA
tttcattttacaggtgaggcaac

SEQ ID NO: 16543 - DNA, 23 bp, Artificial Sequence
  X-linked inhibitor of apoptosis (XIAP) siRNA
ttcattttacaggtgaggcaact

SEQ ID NO: 16544 - DNA, 23 bp, Artificial Sequence
  X-linked inhibitor of apoptosis (XIAP) siRNA
tcattttacaggtgaggcaactg

SEQ ID NO: 16545 - DNA, 23 bp, Artificial Sequence
  X-linked inhibitor of apoptosis (XIAP) siRNA
cattttacaggtgaggcaactga

SEQ ID NO: 16546 - DNA, 23 bp, Artificial Sequence
  X-linked inhibitor of apoptosis (XIAP) siRNA
attttacaggtgaggcaactgag

SEQ ID NO: 16547 - DNA, 23 bp, Artificial Sequence
  X-linked inhibitor of apoptosis (XIAP) siRNA
ttttacaggtgaggcaactgaga

SEQ ID NO: 16548 - DNA, 23 bp, Artificial Sequence
  X-linked inhibitor of apoptosis (XIAP) siRNA
tttacaggtgaggcaactgagac

SEQ ID NO: 16549 - DNA, 23 bp, Artificial Sequence
  X-linked inhibitor of apoptosis (XIAP) siRNA
ttacaggtgaggcaactgagact

SEQ ID NO: 16550 - DNA, 23 bp, Artificial Sequence
  X-linked inhibitor of apoptosis (XIAP) siRNA
tacaggtgaggcaactgagactc

SEQ ID NO: 16551 - DNA, 23 bp, Artificial Sequence
  X-linked inhibitor of apoptosis (XIAP) siRNA
acaggtgaggcaactgagactca

SEQ ID NO: 16552 - DNA, 23 bp, Artificial Sequence
  X-linked inhibitor of apoptosis (XIAP) siRNA
caggtgaggcaactgagactcaa

SEQ ID NO: 16553 - DNA, 23 bp, Artificial Sequence
  X-linked inhibitor of apoptosis (XIAP) siRNA
aggtgaggcaactgagactcaaa

SEQ ID NO: 16554 - DNA, 23 bp, Artificial Sequence
  X-linked inhibitor of apoptosis (XIAP) siRNA
ggtgaggcaactgagactcaaag

SEQ ID NO: 16555 - DNA, 23 bp, Artificial Sequence
  X-linked inhibitor of apoptosis (XIAP) siRNA
gtgaggcaactgagactcaaagg

SEQ ID NO: 16556 - DNA, 23 bp, Artificial Sequence
  X-linked inhibitor of apoptosis (XIAP) siRNA
tgaggcaactgagactcaaaggt

SEQ ID NO: 16557 - DNA, 23 bp, Artificial Sequence
  X-linked inhibitor of apoptosis (XIAP) siRNA
gaggcaactgagactcaaaggtg

SEQ ID NO: 16558 - DNA, 23 bp, Artificial Sequence
  X-linked inhibitor of apoptosis (XIAP) siRNA
aggcaactgagactcaaaggtga

SEQ ID NO: 16559 - DNA, 23 bp, Artificial Sequence
  X-linked inhibitor of apoptosis (XIAP) siRNA
ggcaactgagactcaaaggtgat

SEQ ID NO: 16560 - DNA, 23 bp, Artificial Sequence
  X-linked inhibitor of apoptosis (XIAP) siRNA
gcaactgagactcaaaggtgatg

SEQ ID NO: 16561 - DNA, 23 bp, Artificial Sequence
  X-linked inhibitor of apoptosis (XIAP) siRNA
caactgagactcaaaggtgatgt

SEQ ID NO: 16562 - DNA, 23 bp, Artificial Sequence
  X-linked inhibitor of apoptosis (XIAP) siRNA
aactgagactcaaaggtgatgta

SEQ ID NO: 16563 - DNA, 23 bp, Artificial Sequence
  X-linked inhibitor of apoptosis (XIAP) siRNA
actgagactcaaaggtgatgtaa

SEQ ID NO: 16564 - DNA, 23 bp, Artificial Sequence
  X-linked inhibitor of apoptosis (XIAP) siRNA
ctgagactcaaaggtgatgtaat

SEQ ID NO: 16565 - DNA, 23 bp, Artificial Sequence
  X-linked inhibitor of apoptosis (XIAP) siRNA
tgagactcaaaggtgatgtaatt

SEQ ID NO: 16566 - DNA, 23 bp, Artificial Sequence
  X-linked inhibitor of apoptosis (XIAP) siRNA
gagactcaaaggtgatgtaattt

SEQ ID NO: 16567 - DNA, 23 bp, Artificial Sequence
  X-linked inhibitor of apoptosis (XIAP) siRNA
agactcaaaggtgatgtaatttg

SEQ ID NO: 16568 - DNA, 23 bp, Artificial Sequence
  X-linked inhibitor of apoptosis (XIAP) siRNA
gactcaaaggtgatgtaatttgt

SEQ ID NO: 16569 - DNA, 23 bp, Artificial Sequence
  X-linked inhibitor of apoptosis (XIAP) siRNA
actcaaaggtgatgtaatttgtg

SEQ ID NO: 16570 - DNA, 23 bp, Artificial Sequence
  X-linked inhibitor of apoptosis (XIAP) siRNA
ctcaaaggtgatgtaatttgtgc

SEQ ID NO: 16571 - DNA, 23 bp, Artificial Sequence
  X-linked inhibitor of apoptosis (XIAP) siRNA
tcaaaggtgatgtaatttgtgca

SEQ ID NO: 16572 - DNA, 23 bp, Artificial Sequence
  X-linked inhibitor of apoptosis (XIAP) siRNA
caaaggtgatgtaatttgtgcaa

SEQ ID NO: 16573 - DNA, 23 bp, Artificial Sequence
  X-linked inhibitor of apoptosis (XIAP) siRNA
aaaggtgatgtaatttgtgcaaa

SEQ ID NO: 16574 - DNA, 23 bp, Artificial Sequence
  X-linked inhibitor of apoptosis (XIAP) siRNA
aaggtgatgtaatttgtgcaaag

SEQ ID NO: 16575 - DNA, 23 bp, Artificial Sequence
  X-linked inhibitor of apoptosis (XIAP) siRNA
aggtgatgtaatttgtgcaaaga

SEQ ID NO: 16576 - DNA, 23 bp, Artificial Sequence
  X-linked inhibitor of apoptosis (XIAP) siRNA
ggtgatgtaatttgtgcaaagat

SEQ ID NO: 16577 - DNA, 23 bp, Artificial Sequence
  X-linked inhibitor of apoptosis (XIAP) siRNA
gtgatgtaatttgtgcaaagatt

SEQ ID NO: 16578 - DNA, 23 bp, Artificial Sequence
  X-linked inhibitor of apoptosis (XIAP) siRNA
tgatgtaatttgtgcaaagatta

SEQ ID NO: 16579 - DNA, 23 bp, Artificial Sequence
  X-linked inhibitor of apoptosis (XIAP) siRNA
gatgtaatttgtgcaaagattat

SEQ ID NO: 16580 - DNA, 23 bp, Artificial Sequence
  X-linked inhibitor of apoptosis (XIAP) siRNA
atgtaatttgtgcaaagattata

SEQ ID NO: 16581 - DNA, 23 bp, Artificial Sequence
  X-linked inhibitor of apoptosis (XIAP) siRNA
tgtaatttgtgcaaagattatag

SEQ ID NO: 16582 - DNA, 23 bp, Artificial Sequence
  X-linked inhibitor of apoptosis (XIAP) siRNA
gtaatttgtgcaaagattatagc

SEQ ID NO: 16583 - DNA, 23 bp, Artificial Sequence
  X-linked inhibitor of apoptosis (XIAP) siRNA
taatttgtgcaaagattatagct

SEQ ID NO: 16584 - DNA, 23 bp, Artificial Sequence
  X-linked inhibitor of apoptosis (XIAP) siRNA
aatttgtgcaaagattatagcta

SEQ ID NO: 16585 - DNA, 23 bp, Artificial Sequence
  X-linked inhibitor of apoptosis (XIAP) siRNA
atttgtgcaaagattatagctaa

SEQ ID NO: 16586 - DNA, 23 bp, Artificial Sequence
  X-linked inhibitor of apoptosis (XIAP) siRNA
tttgtgcaaagattatagctaat

SEQ ID NO: 16587 - DNA, 23 bp, Artificial Sequence
  X-linked inhibitor of apoptosis (XIAP) siRNA
ttgtgcaaagattatagctaatt

SEQ ID NO: 16588 - DNA, 23 bp, Artificial Sequence
  X-linked inhibitor of apoptosis (XIAP) siRNA
tgtgcaaagattatagctaatta

SEQ ID NO: 16589 - DNA, 23 bp, Artificial Sequence
  X-linked inhibitor of apoptosis (XIAP) siRNA
gtgcaaagattatagctaattag

SEQ ID NO: 16590 - DNA, 23 bp, Artificial Sequence
  X-linked inhibitor of apoptosis (XIAP) siRNA
tgcaaagattatagctaattagt

SEQ ID NO: 16591 - DNA, 23 bp, Artificial Sequence
  X-linked inhibitor of apoptosis (XIAP) siRNA
gcaaagattatagctaattagta

SEQ ID NO: 16592 - DNA, 23 bp, Artificial Sequence
  X-linked inhibitor of apoptosis (XIAP) siRNA
caaagattatagctaattagtag

SEQ ID NO: 16593 - DNA, 23 bp, Artificial Sequence
  X-linked inhibitor of apoptosis (XIAP) siRNA
aaagattatagctaattagtagc

SEQ ID NO: 16594 - DNA, 23 bp, Artificial Sequence
  X-linked inhibitor of apoptosis (XIAP) siRNA
aagattatagctaattagtagca

SEQ ID NO: 16595 - DNA, 23 bp, Artificial Sequence
  X-linked inhibitor of apoptosis (XIAP) siRNA
agattatagctaattagtagcag

SEQ ID NO: 16596 - DNA, 23 bp, Artificial Sequence
  X-linked inhibitor of apoptosis (XIAP) siRNA
gattatagctaattagtagcaga

SEQ ID NO: 16597 - DNA, 23 bp, Artificial Sequence
  X-linked inhibitor of apoptosis (XIAP) siRNA
attatagctaattagtagcagag

SEQ ID NO: 16598 - DNA, 23 bp, Artificial Sequence
  X-linked inhibitor of apoptosis (XIAP) siRNA
ttatagctaattagtagcagagc

SEQ ID NO: 16599 - DNA, 23 bp, Artificial Sequence
  X-linked inhibitor of apoptosis (XIAP) siRNA
tatagctaattagtagcagagcc

SEQ ID NO: 16600 - DNA, 23 bp, Artificial Sequence
  X-linked inhibitor of apoptosis (XIAP) siRNA
atagctaattagtagcagagccc

SEQ ID NO: 16601 - DNA, 23 bp, Artificial Sequence
  X-linked inhibitor of apoptosis (XIAP) siRNA
tagctaattagtagcagagccct

SEQ ID NO: 16602 - DNA, 23 bp, Artificial Sequence
  X-linked inhibitor of apoptosis (XIAP) siRNA
agctaattagtagcagagccctg

SEQ ID NO: 16603 - DNA, 23 bp, Artificial Sequence
  X-linked inhibitor of apoptosis (XIAP) siRNA
gctaattagtagcagagccctga

SEQ ID NO: 16604 - DNA, 23 bp, Artificial Sequence
  X-linked inhibitor of apoptosis (XIAP) siRNA
ctaattagtagcagagccctgac

SEQ ID NO: 16605 - DNA, 23 bp, Artificial Sequence
  X-linked inhibitor of apoptosis (XIAP) siRNA
taattagtagcagagccctgact

SEQ ID NO: 16606 - DNA, 23 bp, Artificial Sequence
  X-linked inhibitor of apoptosis (XIAP) siRNA
aattagtagcagagccctgactg

SEQ ID NO: 16607 - DNA, 23 bp, Artificial Sequence
  X-linked inhibitor of apoptosis (XIAP) siRNA
attagtagcagagccctgactgg

SEQ ID NO: 16608 - DNA, 23 bp, Artificial Sequence
  X-linked inhibitor of apoptosis (XIAP) siRNA
ttagtagcagagccctgactggg

SEQ ID NO: 16609 - DNA, 23 bp, Artificial Sequence
  X-linked inhibitor of apoptosis (XIAP) siRNA
tagtagcagagccctgactggga

SEQ ID NO: 16610 - DNA, 23 bp, Artificial Sequence
  X-linked inhibitor of apoptosis (XIAP) siRNA
agtagcagagccctgactgggac

SEQ ID NO: 16611 - DNA, 23 bp, Artificial Sequence
  X-linked inhibitor of apoptosis (XIAP) siRNA
gtagcagagccctgactgggaca

SEQ ID NO: 16612 - DNA, 23 bp, Artificial Sequence
  X-linked inhibitor of apoptosis (XIAP) siRNA
tagcagagccctgactgggacat

SEQ ID NO: 16613 - DNA, 23 bp, Artificial Sequence
  X-linked inhibitor of apoptosis (XIAP) siRNA
agcagagccctgactgggacata

SEQ ID NO: 16614 - DNA, 23 bp, Artificial Sequence
  X-linked inhibitor of apoptosis (XIAP) siRNA
gcagagccctgactgggacatag

SEQ ID NO: 16615 - DNA, 23 bp, Artificial Sequence
  X-linked inhibitor of apoptosis (XIAP) siRNA
cagagccctgactgggacatagt

SEQ ID NO: 16616 - DNA, 23 bp, Artificial Sequence
  X-linked inhibitor of apoptosis (XIAP) siRNA
agagccctgactgggacatagtt

SEQ ID NO: 16617 - DNA, 23 bp, Artificial Sequence
  X-linked inhibitor of apoptosis (XIAP) siRNA
gagccctgactgggacatagttt

SEQ ID NO: 16618 - DNA, 23 bp, Artificial Sequence
  X-linked inhibitor of apoptosis (XIAP) siRNA
agccctgactgggacatagtttg

SEQ ID NO: 16619 - DNA, 23 bp, Artificial Sequence
  X-linked inhibitor of apoptosis (XIAP) siRNA
gccctgactgggacatagtttga

SEQ ID NO: 16620 - DNA, 23 bp, Artificial Sequence
  X-linked inhibitor of apoptosis (XIAP) siRNA
ccctgactgggacatagtttgaa

SEQ ID NO: 16621 - DNA, 23 bp, Artificial Sequence
  X-linked inhibitor of apoptosis (XIAP) siRNA
cctgactgggacatagtttgaag

SEQ ID NO: 16622 - DNA, 23 bp, Artificial Sequence
  X-linked inhibitor of apoptosis (XIAP) siRNA
ctgactgggacatagtttgaagg

SEQ ID NO: 16623 - DNA, 23 bp, Artificial Sequence
  X-linked inhibitor of apoptosis (XIAP) siRNA
tgactgggacatagtttgaaggt

SEQ ID NO: 16624 - DNA, 23 bp, Artificial Sequence
  X-linked inhibitor of apoptosis (XIAP) siRNA
gactgggacatagtttgaaggtg

SEQ ID NO: 16625 - DNA, 23 bp, Artificial Sequence
  X-linked inhibitor of apoptosis (XIAP) siRNA
actgggacatagtttgaaggtga

SEQ ID NO: 16626 - DNA, 23 bp, Artificial Sequence
  X-linked inhibitor of apoptosis (XIAP) siRNA
ctgggacatagtttgaaggtgaa

SEQ ID NO: 16627 - DNA, 23 bp, Artificial Sequence
  X-linked inhibitor of apoptosis (XIAP) siRNA
tgggacatagtttgaaggtgaaa

SEQ ID NO: 16628 - DNA, 23 bp, Artificial Sequence
  X-linked inhibitor of apoptosis (XIAP) siRNA
gggacatagtttgaaggtgaaaa

SEQ ID NO: 16629 - DNA, 23 bp, Artificial Sequence
  X-linked inhibitor of apoptosis (XIAP) siRNA
ggacatagtttgaaggtgaaaaa

SEQ ID NO: 16630 - DNA, 23 bp, Artificial Sequence
  X-linked inhibitor of apoptosis (XIAP) siRNA
gacatagtttgaaggtgaaaaac

SEQ ID NO: 16631 - DNA, 23 bp, Artificial Sequence
  X-linked inhibitor of apoptosis (XIAP) siRNA
acatagtttgaaggtgaaaaact

SEQ ID NO: 16632 - DNA, 23 bp, Artificial Sequence
  X-linked inhibitor of apoptosis (XIAP) siRNA
catagtttgaaggtgaaaaactt

SEQ ID NO: 16633 - DNA, 23 bp, Artificial Sequence
  X-linked inhibitor of apoptosis (XIAP) siRNA
atagtttgaaggtgaaaaacttc

SEQ ID NO: 16634 - DNA, 23 bp, Artificial Sequence
  X-linked inhibitor of apoptosis (XIAP) siRNA
tagtttgaaggtgaaaaacttca

SEQ ID NO: 16635 - DNA, 23 bp, Artificial Sequence
  X-linked inhibitor of apoptosis (XIAP) siRNA
agtttgaaggtgaaaaacttcac

SEQ ID NO: 16636 - DNA, 23 bp, Artificial Sequence
  X-linked inhibitor of apoptosis (XIAP) siRNA
gtttgaaggtgaaaaacttcacc

SEQ ID NO: 16637 - DNA, 23 bp, Artificial Sequence
  X-linked inhibitor of apoptosis (XIAP) siRNA
tttgaaggtgaaaaacttcacca

SEQ ID NO: 16638 - DNA, 23 bp, Artificial Sequence
  X-linked inhibitor of apoptosis (XIAP) siRNA
ttgaaggtgaaaaacttcaccaa

SEQ ID NO: 16639 - DNA, 23 bp, Artificial Sequence
  X-linked inhibitor of apoptosis (XIAP) siRNA
tgaaggtgaaaaacttcaccaag

SEQ ID NO: 16640 - DNA, 23 bp, Artificial Sequence
  X-linked inhibitor of apoptosis (XIAP) siRNA
gaaggtgaaaaacttcaccaagc

SEQ ID NO: 16641 - DNA, 23 bp, Artificial Sequence
  X-linked inhibitor of apoptosis (XIAP) siRNA
aaggtgaaaaacttcaccaagct

SEQ ID NO: 16642 - DNA, 23 bp, Artificial Sequence
  X-linked inhibitor of apoptosis (XIAP) siRNA
aggtgaaaaacttcaccaagcta

SEQ ID NO: 16643 - DNA, 23 bp, Artificial Sequence
  X-linked inhibitor of apoptosis (XIAP) siRNA
ggtgaaaaacttcaccaagctac

SEQ ID NO: 16644 - DNA, 23 bp, Artificial Sequence
  X-linked inhibitor of apoptosis (XIAP) siRNA
gtgaaaaacttcaccaagctacc

SEQ ID NO: 16645 - DNA, 23 bp, Artificial Sequence
  X-linked inhibitor of apoptosis (XIAP) siRNA
tgaaaaacttcaccaagctacct

SEQ ID NO: 16646 - DNA, 23 bp, Artificial Sequence
  X-linked inhibitor of apoptosis (XIAP) siRNA
gaaaaacttcaccaagctacctt

SEQ ID NO: 16647 - DNA, 23 bp, Artificial Sequence
  X-linked inhibitor of apoptosis (XIAP) siRNA
aaaaacttcaccaagctaccttt

SEQ ID NO: 16648 - DNA, 23 bp, Artificial Sequence
  X-linked inhibitor of apoptosis (XIAP) siRNA
aaaacttcaccaagctacctttc

SEQ ID NO: 16649 - DNA, 23 bp, Artificial Sequence
  X-linked inhibitor of apoptosis (XIAP) siRNA
aaacttcaccaagctacctttct

SEQ ID NO: 16650 - DNA, 23 bp, Artificial Sequence
  X-linked inhibitor of apoptosis (XIAP) siRNA
aacttcaccaagctacctttctt

SEQ ID NO: 16651 - DNA, 23 bp, Artificial Sequence
  X-linked inhibitor of apoptosis (XIAP) siRNA
acttcaccaagctacctttcttg

SEQ ID NO: 16652 - DNA, 23 bp, Artificial Sequence
  X-linked inhibitor of apoptosis (XIAP) siRNA
cttcaccaagctacctttcttga

SEQ ID NO: 16653 - DNA, 23 bp, Artificial Sequence
  X-linked inhibitor of apoptosis (XIAP) siRNA
ttcaccaagctacctttcttgaa

SEQ ID NO: 16654 - DNA, 23 bp, Artificial Sequence
  X-linked inhibitor of apoptosis (XIAP) siRNA
tcaccaagctacctttcttgaaa

SEQ ID NO: 16655 - DNA, 23 bp, Artificial Sequence
  X-linked inhibitor of apoptosis (XIAP) siRNA
caccaagctacctttcttgaaag

SEQ ID NO: 16656 - DNA, 23 bp, Artificial Sequence
  X-linked inhibitor of apoptosis (XIAP) siRNA
accaagctacctttcttgaaagg

SEQ ID NO: 16657 - DNA, 23 bp, Artificial Sequence
  X-linked inhibitor of apoptosis (XIAP) siRNA
ccaagctacctttcttgaaaggt

SEQ ID NO: 16658 - DNA, 23 bp, Artificial Sequence
  X-linked inhibitor of apoptosis (XIAP) siRNA
caagctacctttcttgaaaggtc

SEQ ID NO: 16659 - DNA, 23 bp, Artificial Sequence
  X-linked inhibitor of apoptosis (XIAP) siRNA
aagctacctttcttgaaaggtcc

SEQ ID NO: 16660 - DNA, 23 bp, Artificial Sequence
  X-linked inhibitor of apoptosis (XIAP) siRNA
agctacctttcttgaaaggtcca

SEQ ID NO: 16661 - DNA, 23 bp, Artificial Sequence
  X-linked inhibitor of apoptosis (XIAP) siRNA
gctacctttcttgaaaggtccaa

SEQ ID NO: 16662 - DNA, 23 bp, Artificial Sequence
  X-linked inhibitor of apoptosis (XIAP) siRNA
ctacctttcttgaaaggtccaaa

SEQ ID NO: 16663 - DNA, 23 bp, Artificial Sequence
  X-linked inhibitor of apoptosis (XIAP) siRNA
tacctttcttgaaaggtccaaat

SEQ ID NO: 16664 - DNA, 23 bp, Artificial Sequence
  X-linked inhibitor of apoptosis (XIAP) siRNA
acctttcttgaaaggtccaaatg

SEQ ID NO: 16665 - DNA, 23 bp, Artificial Sequence
  X-linked inhibitor of apoptosis (XIAP) siRNA
cctttcttgaaaggtccaaatgt

SEQ ID NO: 16666 - DNA, 23 bp, Artificial Sequence
  X-linked inhibitor of apoptosis (XIAP) siRNA
ctttcttgaaaggtccaaatgtt

SEQ ID NO: 16667 - DNA, 23 bp, Artificial Sequence
  X-linked inhibitor of apoptosis (XIAP) siRNA
tttcttgaaaggtccaaatgttt

SEQ ID NO: 16668 - DNA, 23 bp, Artificial Sequence
  X-linked inhibitor of apoptosis (XIAP) siRNA
ttcttgaaaggtccaaatgttta

SEQ ID NO: 16669 - DNA, 23 bp, Artificial Sequence
  X-linked inhibitor of apoptosis (XIAP) siRNA
tcttgaaaggtccaaatgtttat

SEQ ID NO: 16670 - DNA, 23 bp, Artificial Sequence
  X-linked inhibitor of apoptosis (XIAP) siRNA
cttgaaaggtccaaatgtttatg

SEQ ID NO: 16671 - DNA, 23 bp, Artificial Sequence
  X-linked inhibitor of apoptosis (XIAP) siRNA
ttgaaaggtccaaatgtttatgt

SEQ ID NO: 16672 - DNA, 23 bp, Artificial Sequence
  X-linked inhibitor of apoptosis (XIAP) siRNA
tgaaaggtccaaatgtttatgtt

SEQ ID NO: 16673 - DNA, 23 bp, Artificial Sequence
  X-linked inhibitor of apoptosis (XIAP) siRNA
gaaaggtccaaatgtttatgttt

SEQ ID NO: 16674 - DNA, 23 bp, Artificial Sequence
  X-linked inhibitor of apoptosis (XIAP) siRNA
aaaggtccaaatgtttatgtttt

SEQ ID NO: 16675 - DNA, 23 bp, Artificial Sequence
  X-linked inhibitor of apoptosis (XIAP) siRNA
aaggtccaaatgtttatgttttc

SEQ ID NO: 16676 - DNA, 23 bp, Artificial Sequence
  X-linked inhibitor of apoptosis (XIAP) siRNA
aggtccaaatgtttatgttttca

SEQ ID NO: 16677 - DNA, 23 bp, Artificial Sequence
  X-linked inhibitor of apoptosis (XIAP) siRNA
ggtccaaatgtttatgttttcaa

SEQ ID NO: 16678 - DNA, 23 bp, Artificial Sequence
  X-linked inhibitor of apoptosis (XIAP) siRNA
gtccaaatgtttatgttttcaac

SEQ ID NO: 16679 - DNA, 23 bp, Artificial Sequence
  X-linked inhibitor of apoptosis (XIAP) siRNA
tccaaatgtttatgttttcaact

SEQ ID NO: 16680 - DNA, 23 bp, Artificial Sequence
  X-linked inhibitor of apoptosis (XIAP) siRNA
ccaaatgtttatgttttcaacta

SEQ ID NO: 16681 - DNA, 23 bp, Artificial Sequence
  X-linked inhibitor of apoptosis (XIAP) siRNA
caaatgtttatgttttcaactac

SEQ ID NO: 16682 - DNA, 23 bp, Artificial Sequence
  X-linked inhibitor of apoptosis (XIAP) siRNA
aaatgtttatgttttcaactact

SEQ ID NO: 16683 - DNA, 23 bp, Artificial Sequence
  X-linked inhibitor of apoptosis (XIAP) siRNA
aatgtttatgttttcaactactc

SEQ ID NO: 16684 - DNA, 23 bp, Artificial Sequence
  X-linked inhibitor of apoptosis (XIAP) siRNA
atgtttatgttttcaactactct

SEQ ID NO: 16685 - DNA, 23 bp, Artificial Sequence
  X-linked inhibitor of apoptosis (XIAP) siRNA
tgtttatgttttcaactactctt

SEQ ID NO: 16686 - DNA, 23 bp, Artificial Sequence
  X-linked inhibitor of apoptosis (XIAP) siRNA
gtttatgttttcaactactcttt

SEQ ID NO: 16687 - DNA, 23 bp, Artificial Sequence
  X-linked inhibitor of apoptosis (XIAP) siRNA
tttatgttttcaactactctttc

SEQ ID NO: 16688 - DNA, 23 bp, Artificial Sequence
  X-linked inhibitor of apoptosis (XIAP) siRNA
ttatgttttcaactactctttcc

SEQ ID NO: 16689 - DNA, 23 bp, Artificial Sequence
  X-linked inhibitor of apoptosis (XIAP) siRNA
tatgttttcaactactctttcca

SEQ ID NO: 16690 - DNA, 23 bp, Artificial Sequence
  X-linked inhibitor of apoptosis (XIAP) siRNA
atgttttcaactactctttccac

SEQ ID NO: 16691 - DNA, 23 bp, Artificial Sequence
  X-linked inhibitor of apoptosis (XIAP) siRNA
tgttttcaactactctttccact

SEQ ID NO: 16692 - DNA, 23 bp, Artificial Sequence
  X-linked inhibitor of apoptosis (XIAP) siRNA
gttttcaactactctttccactg

SEQ ID NO: 16693 - DNA, 23 bp, Artificial Sequence
  X-linked inhibitor of apoptosis (XIAP) siRNA
ttttcaactactctttccactgt

SEQ ID NO: 16694 - DNA, 23 bp, Artificial Sequence
  X-linked inhibitor of apoptosis (XIAP) siRNA
tttcaactactctttccactgta

SEQ ID NO: 16695 - DNA, 23 bp, Artificial Sequence
  X-linked inhibitor of apoptosis (XIAP) siRNA
ttcaactactctttccactgtac

SEQ ID NO: 16696 - DNA, 23 bp, Artificial Sequence
  X-linked inhibitor of apoptosis (XIAP) siRNA
tcaactactctttccactgtacc

SEQ ID NO: 16697 - DNA, 23 bp, Artificial Sequence
  X-linked inhibitor of apoptosis (XIAP) siRNA
caactactctttccactgtacca

SEQ ID NO: 16698 - DNA, 23 bp, Artificial Sequence
  X-linked inhibitor of apoptosis (XIAP) siRNA
aactactctttccactgtaccat

SEQ ID NO: 16699 - DNA, 23 bp, Artificial Sequence
  X-linked inhibitor of apoptosis (XIAP) siRNA
actactctttccactgtaccata

SEQ ID NO: 16700 - DNA, 23 bp, Artificial Sequence
  X-linked inhibitor of apoptosis (XIAP) siRNA
ctactctttccactgtaccataa

SEQ ID NO: 16701 - DNA, 23 bp, Artificial Sequence
  X-linked inhibitor of apoptosis (XIAP) siRNA
tactctttccactgtaccataac

SEQ ID NO: 16702 - DNA, 23 bp, Artificial Sequence
  X-linked inhibitor of apoptosis (XIAP) siRNA
actctttccactgtaccataact

SEQ ID NO: 16703 - DNA, 23 bp, Artificial Sequence
  X-linked inhibitor of apoptosis (XIAP) siRNA
ctctttccactgtaccataactt

SEQ ID NO: 16704 - DNA, 23 bp, Artificial Sequence
  X-linked inhibitor of apoptosis (XIAP) siRNA
tctttccactgtaccataacttt

SEQ ID NO: 16705 - DNA, 23 bp, Artificial Sequence
  X-linked inhibitor of apoptosis (XIAP) siRNA
ctttccactgtaccataactttc

SEQ ID NO: 16706 - DNA, 23 bp, Artificial Sequence
  X-linked inhibitor of apoptosis (XIAP) siRNA
tttccactgtaccataactttca

SEQ ID NO: 16707 - DNA, 23 bp, Artificial Sequence
  X-linked inhibitor of apoptosis (XIAP) siRNA
ttccactgtaccataactttcac

SEQ ID NO: 16708 - DNA, 23 bp, Artificial Sequence
  X-linked inhibitor of apoptosis (XIAP) siRNA
tccactgtaccataactttcact

SEQ ID NO: 16709 - DNA, 23 bp, Artificial Sequence
  X-linked inhibitor of apoptosis (XIAP) siRNA
ccactgtaccataactttcacta

SEQ ID NO: 16710 - DNA, 23 bp, Artificial Sequence
  X-linked inhibitor of apoptosis (XIAP) siRNA
cactgtaccataactttcactac

SEQ ID NO: 16711 - DNA, 23 bp, Artificial Sequence
  X-linked inhibitor of apoptosis (XIAP) siRNA
actgtaccataactttcactaca

SEQ ID NO: 16712 - DNA, 23 bp, Artificial Sequence
  X-linked inhibitor of apoptosis (XIAP) siRNA
ctgtaccataactttcactacat

SEQ ID NO: 16713 - DNA, 23 bp, Artificial Sequence
  X-linked inhibitor of apoptosis (XIAP) siRNA
tgtaccataactttcactacata

SEQ ID NO: 16714 - DNA, 23 bp, Artificial Sequence
  X-linked inhibitor of apoptosis (XIAP) siRNA
gtaccataactttcactacatat

SEQ ID NO: 16715 - DNA, 23 bp, Artificial Sequence
  X-linked inhibitor of apoptosis (XIAP) siRNA
taccataactttcactacatatt

SEQ ID NO: 16716 - DNA, 23 bp, Artificial Sequence
  X-linked inhibitor of apoptosis (XIAP) siRNA
accataactttcactacatatta

SEQ ID NO: 16717 - DNA, 23 bp, Artificial Sequence
  X-linked inhibitor of apoptosis (XIAP) siRNA
ccataactttcactacatattaa

SEQ ID NO: 16718 - DNA, 23 bp, Artificial Sequence
  X-linked inhibitor of apoptosis (XIAP) siRNA
cataactttcactacatattaaa

SEQ ID NO: 16719 - DNA, 23 bp, Artificial Sequence
  X-linked inhibitor of apoptosis (XIAP) siRNA
ataactttcactacatattaaat

SEQ ID NO: 16720 - DNA, 23 bp, Artificial Sequence
  X-linked inhibitor of apoptosis (XIAP) siRNA
taactttcactacatattaaatg

SEQ ID NO: 16721 - DNA, 23 bp, Artificial Sequence
  X-linked inhibitor of apoptosis (XIAP) siRNA
aactttcactacatattaaatga

SEQ ID NO: 16722 - DNA, 23 bp, Artificial Sequence
  X-linked inhibitor of apoptosis (XIAP) siRNA
actttcactacatattaaatgac

SEQ ID NO: 16723 - DNA, 23 bp, Artificial Sequence
  X-linked inhibitor of apoptosis (XIAP) siRNA
ctttcactacatattaaatgaca

SEQ ID NO: 16724 - DNA, 23 bp, Artificial Sequence
  X-linked inhibitor of apoptosis (XIAP) siRNA
tttcactacatattaaatgacac

SEQ ID NO: 16725 - DNA, 23 bp, Artificial Sequence
  X-linked inhibitor of apoptosis (XIAP) siRNA
ttcactacatattaaatgacact

SEQ ID NO: 16726 - DNA, 23 bp, Artificial Sequence
  X-linked inhibitor of apoptosis (XIAP) siRNA
tcactacatattaaatgacactt

SEQ ID NO: 16727 - DNA, 23 bp, Artificial Sequence
  X-linked inhibitor of apoptosis (XIAP) siRNA
cactacatattaaatgacacttt

SEQ ID NO: 16728 - DNA, 23 bp, Artificial Sequence
  X-linked inhibitor of apoptosis (XIAP) siRNA
actacatattaaatgacacttta

SEQ ID NO: 16729 - DNA, 23 bp, Artificial Sequence
  X-linked inhibitor of apoptosis (XIAP) siRNA
ctacatattaaatgacactttat

SEQ ID NO: 16730 - DNA, 23 bp, Artificial Sequence
  X-linked inhibitor of apoptosis (XIAP) siRNA
tacatattaaatgacactttata

SEQ ID NO: 16731 - DNA, 23 bp, Artificial Sequence
  X-linked inhibitor of apoptosis (XIAP) siRNA
acatattaaatgacactttataa

SEQ ID NO: 16732 - DNA, 23 bp, Artificial Sequence
  X-linked inhibitor of apoptosis (XIAP) siRNA
catattaaatgacactttataac

SEQ ID NO: 16733 - DNA, 23 bp, Artificial Sequence
  X-linked inhibitor of apoptosis (XIAP) siRNA
atattaaatgacactttataact

SEQ ID NO: 16734 - DNA, 23 bp, Artificial Sequence
  X-linked inhibitor of apoptosis (XIAP) siRNA
tattaaatgacactttataacta

SEQ ID NO: 16735 - DNA, 23 bp, Artificial Sequence
  X-linked inhibitor of apoptosis (XIAP) siRNA
attaaatgacactttataactaa

SEQ ID NO: 16736 - DNA, 23 bp, Artificial Sequence
  X-linked inhibitor of apoptosis (XIAP) siRNA
ttaaatgacactttataactaat

SEQ ID NO: 16737 - DNA, 23 bp, Artificial Sequence
  X-linked inhibitor of apoptosis (XIAP) siRNA
taaatgacactttataactaata

SEQ ID NO: 16738 - DNA, 23 bp, Artificial Sequence
  X-linked inhibitor of apoptosis (XIAP) siRNA
aaatgacactttataactaatat

SEQ ID NO: 16739 - DNA, 23 bp, Artificial Sequence
  X-linked inhibitor of apoptosis (XIAP) siRNA
aatgacactttataactaatata

SEQ ID NO: 16740 - DNA, 23 bp, Artificial Sequence
  X-linked inhibitor of apoptosis (XIAP) siRNA
atgacactttataactaatataa

SEQ ID NO: 16741 - DNA, 23 bp, Artificial Sequence
  X-linked inhibitor of apoptosis (XIAP) siRNA
tgacactttataactaatataat

SEQ ID NO: 16742 - DNA, 23 bp, Artificial Sequence
  X-linked inhibitor of apoptosis (XIAP) siRNA
gacactttataactaatataata

SEQ ID NO: 16743 - DNA, 23 bp, Artificial Sequence
  X-linked inhibitor of apoptosis (XIAP) siRNA
acactttataactaatataatag

SEQ ID NO: 16744 - DNA, 23 bp, Artificial Sequence
  X-linked inhibitor of apoptosis (XIAP) siRNA
cactttataactaatataatagg

SEQ ID NO: 16745 - DNA, 23 bp, Artificial Sequence
  X-linked inhibitor of apoptosis (XIAP) siRNA
actttataactaatataatagga

SEQ ID NO: 16746 - DNA, 23 bp, Artificial Sequence
  X-linked inhibitor of apoptosis (XIAP) siRNA
ctttataactaatataataggac

SEQ ID NO: 16747 - DNA, 23 bp, Artificial Sequence
  X-linked inhibitor of apoptosis (XIAP) siRNA
tttataactaatataataggaca

SEQ ID NO: 16748 - DNA, 23 bp, Artificial Sequence
  X-linked inhibitor of apoptosis (XIAP) siRNA
ttataactaatataataggacaa

SEQ ID NO: 16749 - DNA, 23 bp, Artificial Sequence
  X-linked inhibitor of apoptosis (XIAP) siRNA
tataactaatataataggacaat

SEQ ID NO: 16750 - DNA, 23 bp, Artificial Sequence
  X-linked inhibitor of apoptosis (XIAP) siRNA
ataactaatataataggacaatc

SEQ ID NO: 16751 - DNA, 23 bp, Artificial Sequence
  X-linked inhibitor of apoptosis (XIAP) siRNA
taactaatataataggacaatca

SEQ ID NO: 16752 - DNA, 23 bp, Artificial Sequence
  X-linked inhibitor of apoptosis (XIAP) siRNA
aactaatataataggacaatcat

SEQ ID NO: 16753 - DNA, 23 bp, Artificial Sequence
  X-linked inhibitor of apoptosis (XIAP) siRNA
actaatataataggacaatcatc

SEQ ID NO: 16754 - DNA, 23 bp, Artificial Sequence
  X-linked inhibitor of apoptosis (XIAP) siRNA
ctaatataataggacaatcatca

SEQ ID NO: 16755 - DNA, 23 bp, Artificial Sequence
  X-linked inhibitor of apoptosis (XIAP) siRNA
taatataataggacaatcatcaa

SEQ ID NO: 16756 - DNA, 23 bp, Artificial Sequence
  X-linked inhibitor of apoptosis (XIAP) siRNA
aatataataggacaatcatcaat

SEQ ID NO: 16757 - DNA, 23 bp, Artificial Sequence
  X-linked inhibitor of apoptosis (XIAP) siRNA
atataataggacaatcatcaatg

SEQ ID NO: 16758 - DNA, 23 bp, Artificial Sequence
  X-linked inhibitor of apoptosis (XIAP) siRNA
tataataggacaatcatcaatgc

SEQ ID NO: 16759 - DNA, 23 bp, Artificial Sequence
  X-linked inhibitor of apoptosis (XIAP) siRNA
ataataggacaatcatcaatgca

SEQ ID NO: 16760 - DNA, 23 bp, Artificial Sequence
  X-linked inhibitor of apoptosis (XIAP) siRNA
taataggacaatcatcaatgcat

SEQ ID NO: 16761 - DNA, 23 bp, Artificial Sequence
  X-linked inhibitor of apoptosis (XIAP) siRNA
aataggacaatcatcaatgcata

SEQ ID NO: 16762 - DNA, 23 bp, Artificial Sequence
  X-linked inhibitor of apoptosis (XIAP) siRNA
ataggacaatcatcaatgcatat

SEQ ID NO: 16763 - DNA, 23 bp, Artificial Sequence
  X-linked inhibitor of apoptosis (XIAP) siRNA
taggacaatcatcaatgcatata

SEQ ID NO: 16764 - DNA, 23 bp, Artificial Sequence
  X-linked inhibitor of apoptosis (XIAP) siRNA
aggacaatcatcaatgcatatat

SEQ ID NO: 16765 - DNA, 23 bp, Artificial Sequence
  X-linked inhibitor of apoptosis (XIAP) siRNA
ggacaatcatcaatgcatatata

SEQ ID NO: 16766 - DNA, 23 bp, Artificial Sequence
  X-linked inhibitor of apoptosis (XIAP) siRNA
gacaatcatcaatgcatatatag

SEQ ID NO: 16767 - DNA, 23 bp, Artificial Sequence
  X-linked inhibitor of apoptosis (XIAP) siRNA
acaatcatcaatgcatatatagc

SEQ ID NO: 16768 - DNA, 23 bp, Artificial Sequence
  X-linked inhibitor of apoptosis (XIAP) siRNA
caatcatcaatgcatatatagcc

SEQ ID NO: 16769 - DNA, 23 bp, Artificial Sequence
  X-linked inhibitor of apoptosis (XIAP) siRNA
aatcatcaatgcatatatagcca

SEQ ID NO: 16770 - DNA, 23 bp, Artificial Sequence
  X-linked inhibitor of apoptosis (XIAP) siRNA
atcatcaatgcatatatagccag

SEQ ID NO: 16771 - DNA, 23 bp, Artificial Sequence
  X-linked inhibitor of apoptosis (XIAP) siRNA
tcatcaatgcatatatagccagc

SEQ ID NO: 16772 - DNA, 23 bp, Artificial Sequence
  X-linked inhibitor of apoptosis (XIAP) siRNA
catcaatgcatatatagccagcc

SEQ ID NO: 16773 - DNA, 23 bp, Artificial Sequence
  X-linked inhibitor of apoptosis (XIAP) siRNA
atcaatgcatatatagccagccc

SEQ ID NO: 16774 - DNA, 23 bp, Artificial Sequence
  X-linked inhibitor of apoptosis (XIAP) siRNA
tcaatgcatatatagccagccct

SEQ ID NO: 16775 - DNA, 23 bp, Artificial Sequence
  X-linked inhibitor of apoptosis (XIAP) siRNA
caatgcatatatagccagccctt

SEQ ID NO: 16776 - DNA, 23 bp, Artificial Sequence
  X-linked inhibitor of apoptosis (XIAP) siRNA
aatgcatatatagccagcccttc

SEQ ID NO: 16777 - DNA, 23 bp, Artificial Sequence
  X-linked inhibitor of apoptosis (XIAP) siRNA
atgcatatatagccagcccttca

SEQ ID NO: 16778 - DNA, 23 bp, Artificial Sequence
  X-linked inhibitor of apoptosis (XIAP) siRNA
tgcatatatagccagcccttcat

SEQ ID NO: 16779 - DNA, 23 bp, Artificial Sequence
  X-linked inhibitor of apoptosis (XIAP) siRNA
gcatatatagccagcccttcata

SEQ ID NO: 16780 - DNA, 23 bp, Artificial Sequence
  X-linked inhibitor of apoptosis (XIAP) siRNA
catatatagccagcccttcatat

SEQ ID NO: 16781 - DNA, 23 bp, Artificial Sequence
  X-linked inhibitor of apoptosis (XIAP) siRNA
atatatagccagcccttcatatc

SEQ ID NO: 16782 - DNA, 23 bp, Artificial Sequence
  X-linked inhibitor of apoptosis (XIAP) siRNA
tatatagccagcccttcatatct

SEQ ID NO: 16783 - DNA, 23 bp, Artificial Sequence
  X-linked inhibitor of apoptosis (XIAP) siRNA
atatagccagcccttcatatctg

SEQ ID NO: 16784 - DNA, 23 bp, Artificial Sequence
  X-linked inhibitor of apoptosis (XIAP) siRNA
tatagccagcccttcatatctgt

SEQ ID NO: 16785 - DNA, 23 bp, Artificial Sequence
  X-linked inhibitor of apoptosis (XIAP) siRNA
atagccagcccttcatatctgtg

SEQ ID NO: 16786 - DNA, 23 bp, Artificial Sequence
  X-linked inhibitor of apoptosis (XIAP) siRNA
tagccagcccttcatatctgtgg

SEQ ID NO: 16787 - DNA, 23 bp, Artificial Sequence
  X-linked inhibitor of apoptosis (XIAP) siRNA
agccagcccttcatatctgtggg

SEQ ID NO: 16788 - DNA, 23 bp, Artificial Sequence
  X-linked inhibitor of apoptosis (XIAP) siRNA
gccagcccttcatatctgtgggt

SEQ ID NO: 16789 - DNA, 23 bp, Artificial Sequence
  X-linked inhibitor of apoptosis (XIAP) siRNA
ccagcccttcatatctgtgggtt

SEQ ID NO: 16790 - DNA, 23 bp, Artificial Sequence
  X-linked inhibitor of apoptosis (XIAP) siRNA
cagcccttcatatctgtgggttt

SEQ ID NO: 16791 - DNA, 23 bp, Artificial Sequence
  X-linked inhibitor of apoptosis (XIAP) siRNA
agcccttcatatctgtgggtttt

SEQ ID NO: 16792 - DNA, 23 bp, Artificial Sequence
  X-linked inhibitor of apoptosis (XIAP) siRNA
gcccttcatatctgtgggttttg

SEQ ID NO: 16793 - DNA, 23 bp, Artificial Sequence
  X-linked inhibitor of apoptosis (XIAP) siRNA
cccttcatatctgtgggttttgc

SEQ ID NO: 16794 - DNA, 23 bp, Artificial Sequence
  X-linked inhibitor of apoptosis (XIAP) siRNA
ccttcatatctgtgggttttgca

SEQ ID NO: 16795 - DNA, 23 bp, Artificial Sequence
  X-linked inhibitor of apoptosis (XIAP) siRNA
cttcatatctgtgggttttgcat

SEQ ID NO: 16796 - DNA, 23 bp, Artificial Sequence
  X-linked inhibitor of apoptosis (XIAP) siRNA
ttcatatctgtgggttttgcatc

SEQ ID NO: 16797 - DNA, 23 bp, Artificial Sequence
  X-linked inhibitor of apoptosis (XIAP) siRNA
tcatatctgtgggttttgcatcc

SEQ ID NO: 16798 - DNA, 23 bp, Artificial Sequence
  X-linked inhibitor of apoptosis (XIAP) siRNA
catatctgtgggttttgcatcca

SEQ ID NO: 16799 - DNA, 23 bp, Artificial Sequence
  X-linked inhibitor of apoptosis (XIAP) siRNA
atatctgtgggttttgcatccat

SEQ ID NO: 16800 - DNA, 23 bp, Artificial Sequence
  X-linked inhibitor of apoptosis (XIAP) siRNA
tatctgtgggttttgcatccatg

SEQ ID NO: 16801 - DNA, 23 bp, Artificial Sequence
  X-linked inhibitor of apoptosis (XIAP) siRNA
atctgtgggttttgcatccatgg

SEQ ID NO: 16802 - DNA, 23 bp, Artificial Sequence
  X-linked inhibitor of apoptosis (XIAP) siRNA
tctgtgggttttgcatccatgga

SEQ ID NO: 16803 - DNA, 23 bp, Artificial Sequence
  X-linked inhibitor of apoptosis (XIAP) siRNA
ctgtgggttttgcatccatggat

SEQ ID NO: 16804 - DNA, 23 bp, Artificial Sequence
  X-linked inhibitor of apoptosis (XIAP) siRNA
tgtgggttttgcatccatggatt

SEQ ID NO: 16805 - DNA, 23 bp, Artificial Sequence
  X-linked inhibitor of apoptosis (XIAP) siRNA
gtgggttttgcatccatggattc

SEQ ID NO: 16806 - DNA, 23 bp, Artificial Sequence
  X-linked inhibitor of apoptosis (XIAP) siRNA
tgggttttgcatccatggattca

SEQ ID NO: 16807 - DNA, 23 bp, Artificial Sequence
  X-linked inhibitor of apoptosis (XIAP) siRNA
gggttttgcatccatggattcaa

SEQ ID NO: 16808 - DNA, 23 bp, Artificial Sequence
  X-linked inhibitor of apoptosis (XIAP) siRNA
ggttttgcatccatggattcaac

SEQ ID NO: 16809 - DNA, 23 bp, Artificial Sequence
  X-linked inhibitor of apoptosis (XIAP) siRNA
gttttgcatccatggattcaacc

SEQ ID NO: 16810 - DNA, 23 bp, Artificial Sequence
  X-linked inhibitor of apoptosis (XIAP) siRNA
ttttgcatccatggattcaacca

SEQ ID NO: 16811 - DNA, 23 bp, Artificial Sequence
  X-linked inhibitor of apoptosis (XIAP) siRNA
tttgcatccatggattcaaccaa

SEQ ID NO: 16812 - DNA, 23 bp, Artificial Sequence
  X-linked inhibitor of apoptosis (XIAP) siRNA
ttgcatccatggattcaaccaag

SEQ ID NO: 16813 - DNA, 23 bp, Artificial Sequence
  X-linked inhibitor of apoptosis (XIAP) siRNA
tgcatccatggattcaaccaagg

SEQ ID NO: 16814 - DNA, 23 bp, Artificial Sequence
  X-linked inhibitor of apoptosis (XIAP) siRNA
gcatccatggattcaaccaagga

SEQ ID NO: 16815 - DNA, 23 bp, Artificial Sequence
  X-linked inhibitor of apoptosis (XIAP) siRNA
catccatggattcaaccaaggag

SEQ ID NO: 16816 - DNA, 23 bp, Artificial Sequence
  X-linked inhibitor of apoptosis (XIAP) siRNA
atccatggattcaaccaaggagg

SEQ ID NO: 16817 - DNA, 23 bp, Artificial Sequence
  X-linked inhibitor of apoptosis (XIAP) siRNA
tccatggattcaaccaaggagga

SEQ ID NO: 16818 - DNA, 23 bp, Artificial Sequence
  X-linked inhibitor of apoptosis (XIAP) siRNA
ccatggattcaaccaaggaggaa

SEQ ID NO: 16819 - DNA, 23 bp, Artificial Sequence
  X-linked inhibitor of apoptosis (XIAP) siRNA
catggattcaaccaaggaggaat

SEQ ID NO: 16820 - DNA, 23 bp, Artificial Sequence
  X-linked inhibitor of apoptosis (XIAP) siRNA
atggattcaaccaaggaggaatt

SEQ ID NO: 16821 - DNA, 23 bp, Artificial Sequence
  X-linked inhibitor of apoptosis (XIAP) siRNA
tggattcaaccaaggaggaattg

SEQ ID NO: 16822 - DNA, 23 bp, Artificial Sequence
  X-linked inhibitor of apoptosis (XIAP) siRNA
ggattcaaccaaggaggaattga

SEQ ID NO: 16823 - DNA, 23 bp, Artificial Sequence
  X-linked inhibitor of apoptosis (XIAP) siRNA
gattcaaccaaggaggaattgaa

SEQ ID NO: 16824 - DNA, 23 bp, Artificial Sequence
  X-linked inhibitor of apoptosis (XIAP) siRNA
attcaaccaaggaggaattgaaa

SEQ ID NO: 16825 - DNA, 23 bp, Artificial Sequence
  X-linked inhibitor of apoptosis (XIAP) siRNA
ttcaaccaaggaggaattgaaaa

SEQ ID NO: 16826 - DNA, 23 bp, Artificial Sequence
  X-linked inhibitor of apoptosis (XIAP) siRNA
tcaaccaaggaggaattgaaaac

SEQ ID NO: 16827 - DNA, 23 bp, Artificial Sequence
  X-linked inhibitor of apoptosis (XIAP) siRNA
caaccaaggaggaattgaaaaca

SEQ ID NO: 16828 - DNA, 23 bp, Artificial Sequence
  X-linked inhibitor of apoptosis (XIAP) siRNA
aaccaaggaggaattgaaaacac

SEQ ID NO: 16829 - DNA, 23 bp, Artificial Sequence
  X-linked inhibitor of apoptosis (XIAP) siRNA
accaaggaggaattgaaaacact

SEQ ID NO: 16830 - DNA, 23 bp, Artificial Sequence
  X-linked inhibitor of apoptosis (XIAP) siRNA
ccaaggaggaattgaaaacactg

SEQ ID NO: 16831 - DNA, 23 bp, Artificial Sequence
  X-linked inhibitor of apoptosis (XIAP) siRNA
caaggaggaattgaaaacactga

SEQ ID NO: 16832 - DNA, 23 bp, Artificial Sequence
  X-linked inhibitor of apoptosis (XIAP) siRNA
aaggaggaattgaaaacactgag

SEQ ID NO: 16833 - DNA, 23 bp, Artificial Sequence
  X-linked inhibitor of apoptosis (XIAP) siRNA
aggaggaattgaaaacactgaga

SEQ ID NO: 16834 - DNA, 23 bp, Artificial Sequence
  X-linked inhibitor of apoptosis (XIAP) siRNA
ggaggaattgaaaacactgagaa

SEQ ID NO: 16835 - DNA, 23 bp, Artificial Sequence
  X-linked inhibitor of apoptosis (XIAP) siRNA
gaggaattgaaaacactgagaaa

SEQ ID NO: 16836 - DNA, 23 bp, Artificial Sequence
  X-linked inhibitor of apoptosis (XIAP) siRNA
aggaattgaaaacactgagaaaa

SEQ ID NO: 16837 - DNA, 23 bp, Artificial Sequence
  X-linked inhibitor of apoptosis (XIAP) siRNA
ggaattgaaaacactgagaaaaa

SEQ ID NO: 16838 - DNA, 23 bp, Artificial Sequence
  X-linked inhibitor of apoptosis (XIAP) siRNA
gaattgaaaacactgagaaaaaa

SEQ ID NO: 16839 - DNA, 23 bp, Artificial Sequence
  X-linked inhibitor of apoptosis (XIAP) siRNA
aattgaaaacactgagaaaaaaa

SEQ ID NO: 16840 - DNA, 23 bp, Artificial Sequence
  X-linked inhibitor of apoptosis (XIAP) siRNA
attgaaaacactgagaaaaaaaa

SEQ ID NO: 16841 - DNA, 23 bp, Artificial Sequence
  X-linked inhibitor of apoptosis (XIAP) siRNA
aaaaaaaagaccacacaataaaa

SEQ ID NO: 16842 - DNA, 23 bp, Artificial Sequence
  X-linked inhibitor of apoptosis (XIAP) siRNA
aaaaaaagaccacacaataaaaa

SEQ ID NO: 16843 - DNA, 23 bp, Artificial Sequence
  X-linked inhibitor of apoptosis (XIAP) siRNA
aaaaaagaccacacaataaaaaa

SEQ ID NO: 16844 - DNA, 23 bp, Artificial Sequence
  X-linked inhibitor of apoptosis (XIAP) siRNA
aaaaagaccacacaataaaaaaa

SEQ ID NO: 16845 - DNA, 23 bp, Artificial Sequence
  X-linked inhibitor of apoptosis (XIAP) siRNA
aaaagaccacacaataaaaaaaa

SEQ ID NO: 16846 - DNA, 23 bp, Artificial Sequence
  X-linked inhibitor of apoptosis (XIAP) siRNA
aaaaaaaatacaaaataatacaa

SEQ ID NO: 16847 - DNA, 23 bp, Artificial Sequence
  X-linked inhibitor of apoptosis (XIAP) siRNA
aaaaaaatacaaaataatacaaa

SEQ ID NO: 16848 - DNA, 23 bp, Artificial Sequence
  X-linked inhibitor of apoptosis (XIAP) siRNA
aaaaaatacaaaataatacaaag

SEQ ID NO: 16849 - DNA, 23 bp, Artificial Sequence
  X-linked inhibitor of apoptosis (XIAP) siRNA
aaaaatacaaaataatacaaaga

SEQ ID NO: 16850 - DNA, 23 bp, Artificial Sequence
  X-linked inhibitor of apoptosis (XIAP) siRNA
aaaatacaaaataatacaaagaa

SEQ ID NO: 16851 - DNA, 23 bp, Artificial Sequence
  X-linked inhibitor of apoptosis (XIAP) siRNA
aaatacaaaataatacaaagaaa

SEQ ID NO: 16852 - DNA, 23 bp, Artificial Sequence
  X-linked inhibitor of apoptosis (XIAP) siRNA
aatacaaaataatacaaagaaaa

SEQ ID NO: 16853 - DNA, 23 bp, Artificial Sequence
  X-linked inhibitor of apoptosis (XIAP) siRNA
atacaaaataatacaaagaaaaa

SEQ ID NO: 16854 - DNA, 23 bp, Artificial Sequence
  X-linked inhibitor of apoptosis (XIAP) siRNA
tacaaaataatacaaagaaaaag

SEQ ID NO: 16855 - DNA, 23 bp, Artificial Sequence
  X-linked inhibitor of apoptosis (XIAP) siRNA
acaaaataatacaaagaaaaagc

SEQ ID NO: 16856 - DNA, 23 bp, Artificial Sequence
  X-linked inhibitor of apoptosis (XIAP) siRNA
caaaataatacaaagaaaaagcc

SEQ ID NO: 16857 - DNA, 23 bp, Artificial Sequence
  X-linked inhibitor of apoptosis (XIAP) siRNA
aaaataatacaaagaaaaagcca

SEQ ID NO: 16858 - DNA, 23 bp, Artificial Sequence
  X-linked inhibitor of apoptosis (XIAP) siRNA
aaataatacaaagaaaaagccaa

SEQ ID NO: 16859 - DNA, 23 bp, Artificial Sequence
  X-linked inhibitor of apoptosis (XIAP) siRNA
aataatacaaagaaaaagccaaa

SEQ ID NO: 16860 - DNA, 23 bp, Artificial Sequence
  X-linked inhibitor of apoptosis (XIAP) siRNA
ataatacaaagaaaaagccaaaa

SEQ ID NO: 16861 - DNA, 23 bp, Artificial Sequence
  X-linked inhibitor of apoptosis (XIAP) siRNA
taatacaaagaaaaagccaaaat

SEQ ID NO: 16862 - DNA, 23 bp, Artificial Sequence
  X-linked inhibitor of apoptosis (XIAP) siRNA
aatacaaagaaaaagccaaaatt

SEQ ID NO: 16863 - DNA, 23 bp, Artificial Sequence
  X-linked inhibitor of apoptosis (XIAP) siRNA
atacaaagaaaaagccaaaattg

SEQ ID NO: 16864 - DNA, 23 bp, Artificial Sequence
  X-linked inhibitor of apoptosis (XIAP) siRNA
tacaaagaaaaagccaaaattgt

SEQ ID NO: 16865 - DNA, 23 bp, Artificial Sequence
  X-linked inhibitor of apoptosis (XIAP) siRNA
acaaagaaaaagccaaaattgtc

SEQ ID NO: 16866 - DNA, 23 bp, Artificial Sequence
  X-linked inhibitor of apoptosis (XIAP) siRNA
caaagaaaaagccaaaattgtca

SEQ ID NO: 16867 - DNA, 23 bp, Artificial Sequence
  X-linked inhibitor of apoptosis (XIAP) siRNA
aaagaaaaagccaaaattgtcat

SEQ ID NO: 16868 - DNA, 23 bp, Artificial Sequence
  X-linked inhibitor of apoptosis (XIAP) siRNA
aagaaaaagccaaaattgtcata

SEQ ID NO: 16869 - DNA, 23 bp, Artificial Sequence
  X-linked inhibitor of apoptosis (XIAP) siRNA
agaaaaagccaaaattgtcatac

SEQ ID NO: 16870 - DNA, 23 bp, Artificial Sequence
  X-linked inhibitor of apoptosis (XIAP) siRNA
gaaaaagccaaaattgtcatact

SEQ ID NO: 16871 - DNA, 23 bp, Artificial Sequence
  X-linked inhibitor of apoptosis (XIAP) siRNA
aaaaagccaaaattgtcatactg

SEQ ID NO: 16872 - DNA, 23 bp, Artificial Sequence
  X-linked inhibitor of apoptosis (XIAP) siRNA
aaaagccaaaattgtcatactgt

SEQ ID NO: 16873 - DNA, 23 bp, Artificial Sequence
  X-linked inhibitor of apoptosis (XIAP) siRNA
aaagccaaaattgtcatactgtt

SEQ ID NO: 16874 - DNA, 23 bp, Artificial Sequence
  X-linked inhibitor of apoptosis (XIAP) siRNA
aagccaaaattgtcatactgttg

SEQ ID NO: 16875 - DNA, 23 bp, Artificial Sequence
  X-linked inhibitor of apoptosis (XIAP) siRNA
agccaaaattgtcatactgttgt

SEQ ID NO: 16876 - DNA, 23 bp, Artificial Sequence
  X-linked inhibitor of apoptosis (XIAP) siRNA
gccaaaattgtcatactgttgtt

SEQ ID NO: 16877 - DNA, 23 bp, Artificial Sequence
  X-linked inhibitor of apoptosis (XIAP) siRNA
ccaaaattgtcatactgttgtta

SEQ ID NO: 16878 - DNA, 23 bp, Artificial Sequence
  X-linked inhibitor of apoptosis (XIAP) siRNA
caaaattgtcatactgttgttaa

SEQ ID NO: 16879 - DNA, 23 bp, Artificial Sequence
  X-linked inhibitor of apoptosis (XIAP) siRNA
aaaattgtcatactgttgttaag

SEQ ID NO: 16880 - DNA, 23 bp, Artificial Sequence
  X-linked inhibitor of apoptosis (XIAP) siRNA
aaattgtcatactgttgttaagc

SEQ ID NO: 16881 - DNA, 23 bp, Artificial Sequence
  X-linked inhibitor of apoptosis (XIAP) siRNA
aattgtcatactgttgttaagca

SEQ ID NO: 16882 - DNA, 23 bp, Artificial Sequence
  X-linked inhibitor of apoptosis (XIAP) siRNA
attgtcatactgttgttaagcaa

SEQ ID NO: 16883 - DNA, 23 bp, Artificial Sequence
  X-linked inhibitor of apoptosis (XIAP) siRNA
ttgtcatactgttgttaagcaac

SEQ ID NO: 16884 - DNA, 23 bp, Artificial Sequence
  X-linked inhibitor of apoptosis (XIAP) siRNA
tgtcatactgttgttaagcaaca

SEQ ID NO: 16885 - DNA, 23 bp, Artificial Sequence
  X-linked inhibitor of apoptosis (XIAP) siRNA
gtcatactgttgttaagcaacag

SEQ ID NO: 16886 - DNA, 23 bp, Artificial Sequence
  X-linked inhibitor of apoptosis (XIAP) siRNA
tcatactgttgttaagcaacagt

SEQ ID NO: 16887 - DNA, 23 bp, Artificial Sequence
  X-linked inhibitor of apoptosis (XIAP) siRNA
catactgttgttaagcaacagta

SEQ ID NO: 16888 - DNA, 23 bp, Artificial Sequence
  X-linked inhibitor of apoptosis (XIAP) siRNA
atactgttgttaagcaacagtat

SEQ ID NO: 16889 - DNA, 23 bp, Artificial Sequence
  X-linked inhibitor of apoptosis (XIAP) siRNA
tactgttgttaagcaacagtata

SEQ ID NO: 16890 - DNA, 23 bp, Artificial Sequence
  X-linked inhibitor of apoptosis (XIAP) siRNA
actgttgttaagcaacagtataa

SEQ ID NO: 16891 - DNA, 23 bp, Artificial Sequence
  X-linked inhibitor of apoptosis (XIAP) siRNA
ctgttgttaagcaacagtataac

SEQ ID NO: 16892 - DNA, 23 bp, Artificial Sequence
  X-linked inhibitor of apoptosis (XIAP) siRNA
tgttgttaagcaacagtataaca

SEQ ID NO: 16893 - DNA, 23 bp, Artificial Sequence
  X-linked inhibitor of apoptosis (XIAP) siRNA
gttgttaagcaacagtataacaa

SEQ ID NO: 16894 - DNA, 23 bp, Artificial Sequence
  X-linked inhibitor of apoptosis (XIAP) siRNA
ttgttaagcaacagtataacaac

SEQ ID NO: 16895 - DNA, 23 bp, Artificial Sequence
  X-linked inhibitor of apoptosis (XIAP) siRNA
tgttaagcaacagtataacaact

SEQ ID NO: 16896 - DNA, 23 bp, Artificial Sequence
  X-linked inhibitor of apoptosis (XIAP) siRNA
gttaagcaacagtataacaacta

SEQ ID NO: 16897 - DNA, 23 bp, Artificial Sequence
  X-linked inhibitor of apoptosis (XIAP) siRNA
ttaagcaacagtataacaactat

SEQ ID NO: 16898 - DNA, 23 bp, Artificial Sequence
  X-linked inhibitor of apoptosis (XIAP) siRNA
taagcaacagtataacaactatt

SEQ ID NO: 16899 - DNA, 23 bp, Artificial Sequence
  X-linked inhibitor of apoptosis (XIAP) siRNA
aagcaacagtataacaactattt

SEQ ID NO: 16900 - DNA, 23 bp, Artificial Sequence
  X-linked inhibitor of apoptosis (XIAP) siRNA
agcaacagtataacaactattta

SEQ ID NO: 16901 - DNA, 23 bp, Artificial Sequence
  X-linked inhibitor of apoptosis (XIAP) siRNA
gcaacagtataacaactatttac

SEQ ID NO: 16902 - DNA, 23 bp, Artificial Sequence
  X-linked inhibitor of apoptosis (XIAP) siRNA
caacagtataacaactatttaca

SEQ ID NO: 16903 - DNA, 23 bp, Artificial Sequence
  X-linked inhibitor of apoptosis (XIAP) siRNA
aacagtataacaactatttacat

SEQ ID NO: 16904 - DNA, 23 bp, Artificial Sequence
  X-linked inhibitor of apoptosis (XIAP) siRNA
acagtataacaactatttacata

SEQ ID NO: 16905 - DNA, 23 bp, Artificial Sequence
  X-linked inhibitor of apoptosis (XIAP) siRNA
cagtataacaactatttacatag

SEQ ID NO: 16906 - DNA, 23 bp, Artificial Sequence
  X-linked inhibitor of apoptosis (XIAP) siRNA
agtataacaactatttacatagc

SEQ ID NO: 16907 - DNA, 23 bp, Artificial Sequence
  X-linked inhibitor of apoptosis (XIAP) siRNA
gtataacaactatttacatagca

SEQ ID NO: 16908 - DNA, 23 bp, Artificial Sequence
  X-linked inhibitor of apoptosis (XIAP) siRNA
tataacaactatttacatagcat

SEQ ID NO: 16909 - DNA, 23 bp, Artificial Sequence
  X-linked inhibitor of apoptosis (XIAP) siRNA
ataacaactatttacatagcatt

SEQ ID NO: 16910 - DNA, 23 bp, Artificial Sequence
  X-linked inhibitor of apoptosis (XIAP) siRNA
taacaactatttacatagcatta

SEQ ID NO: 16911 - DNA, 23 bp, Artificial Sequence
  X-linked inhibitor of apoptosis (XIAP) siRNA
aacaactatttacatagcattaa

SEQ ID NO: 16912 - DNA, 23 bp, Artificial Sequence
  X-linked inhibitor of apoptosis (XIAP) siRNA
acaactatttacatagcattaag

SEQ ID NO: 16913 - DNA, 23 bp, Artificial Sequence
  X-linked inhibitor of apoptosis (XIAP) siRNA
caactatttacatagcattaagg

SEQ ID NO: 16914 - DNA, 23 bp, Artificial Sequence
  X-linked inhibitor of apoptosis (XIAP) siRNA
aactatttacatagcattaaggt

SEQ ID NO: 16915 - DNA, 23 bp, Artificial Sequence
  X-linked inhibitor of apoptosis (XIAP) siRNA
actatttacatagcattaaggtt

SEQ ID NO: 16916 - DNA, 23 bp, Artificial Sequence
  X-linked inhibitor of apoptosis (XIAP) siRNA
ctatttacatagcattaaggttg

SEQ ID NO: 16917 - DNA, 23 bp, Artificial Sequence
  X-linked inhibitor of apoptosis (XIAP) siRNA
tatttacatagcattaaggttgg

SEQ ID NO: 16918 - DNA, 23 bp, Artificial Sequence
  X-linked inhibitor of apoptosis (XIAP) siRNA
atttacatagcattaaggttggt

SEQ ID NO: 16919 - DNA, 23 bp, Artificial Sequence
  X-linked inhibitor of apoptosis (XIAP) siRNA
tttacatagcattaaggttggtg

SEQ ID NO: 16920 - DNA, 23 bp, Artificial Sequence
  X-linked inhibitor of apoptosis (XIAP) siRNA
ttacatagcattaaggttggtgc

SEQ ID NO: 16921 - DNA, 23 bp, Artificial Sequence
  X-linked inhibitor of apoptosis (XIAP) siRNA
tacatagcattaaggttggtgca

SEQ ID NO: 16922 - DNA, 23 bp, Artificial Sequence
  X-linked inhibitor of apoptosis (XIAP) siRNA
acatagcattaaggttggtgcaa

SEQ ID NO: 16923 - DNA, 23 bp, Artificial Sequence
  X-linked inhibitor of apoptosis (XIAP) siRNA
catagcattaaggttggtgcaaa

SEQ ID NO: 16924 - DNA, 23 bp, Artificial Sequence
  X-linked inhibitor of apoptosis (XIAP) siRNA
atagcattaaggttggtgcaaaa

SEQ ID NO: 16925 - DNA, 23 bp, Artificial Sequence
  X-linked inhibitor of apoptosis (XIAP) siRNA
tagcattaaggttggtgcaaaaa

SEQ ID NO: 16926 - DNA, 23 bp, Artificial Sequence
  X-linked inhibitor of apoptosis (XIAP) siRNA
agcattaaggttggtgcaaaaat

SEQ ID NO: 16927 - DNA, 23 bp, Artificial Sequence
  X-linked inhibitor of apoptosis (XIAP) siRNA
gcattaaggttggtgcaaaaatg

SEQ ID NO: 16928 - DNA, 23 bp, Artificial Sequence
  X-linked inhibitor of apoptosis (XIAP) siRNA
cattaaggttggtgcaaaaatgc

SEQ ID NO: 16929 - DNA, 23 bp, Artificial Sequence
  X-linked inhibitor of apoptosis (XIAP) siRNA
attaaggttggtgcaaaaatgca

SEQ ID NO: 16930 - DNA, 23 bp, Artificial Sequence
  X-linked inhibitor of apoptosis (XIAP) siRNA
ttaaggttggtgcaaaaatgcaa

SEQ ID NO: 16931 - DNA, 23 bp, Artificial Sequence
  X-linked inhibitor of apoptosis (XIAP) siRNA
taaggttggtgcaaaaatgcaaa

SEQ ID NO: 16932 - DNA, 23 bp, Artificial Sequence
  X-linked inhibitor of apoptosis (XIAP) siRNA
aaggttggtgcaaaaatgcaaaa

SEQ ID NO: 16933 - DNA, 23 bp, Artificial Sequence
  X-linked inhibitor of apoptosis (XIAP) siRNA
aggttggtgcaaaaatgcaaaaa

SEQ ID NO: 16934 - DNA, 23 bp, Artificial Sequence
  X-linked inhibitor of apoptosis (XIAP) siRNA
ggttggtgcaaaaatgcaaaaaa

SEQ ID NO: 16935 - DNA, 23 bp, Artificial Sequence
  X-linked inhibitor of apoptosis (XIAP) siRNA
gttggtgcaaaaatgcaaaaaaa

SEQ ID NO: 16936 - DNA, 23 bp, Artificial Sequence
  X-linked inhibitor of apoptosis (XIAP) siRNA
ttggtgcaaaaatgcaaaaaaaa

SEQ ID NO: 16937 - DNA, 23 bp, Artificial Sequence
  X-linked inhibitor of apoptosis (XIAP) siRNA
aaaaaaaagcaattatttttaaa

SEQ ID NO: 16938 - DNA, 23 bp, Artificial Sequence
  X-linked inhibitor of apoptosis (XIAP) siRNA
aaaaaaagcaattatttttaaac

SEQ ID NO: 16939 - DNA, 23 bp, Artificial Sequence
  X-linked inhibitor of apoptosis (XIAP) siRNA
aaaaaagcaattatttttaaacc

SEQ ID NO: 16940 - DNA, 23 bp, Artificial Sequence
  X-linked inhibitor of apoptosis (XIAP) siRNA
aaaaagcaattatttttaaacca

SEQ ID NO: 16941 - DNA, 23 bp, Artificial Sequence
  X-linked inhibitor of apoptosis (XIAP) siRNA
aaaagcaattatttttaaaccaa

SEQ ID NO: 16942 - DNA, 23 bp, Artificial Sequence
  X-linked inhibitor of apoptosis (XIAP) siRNA
aaagcaattatttttaaaccaac

SEQ ID NO: 16943 - DNA, 23 bp, Artificial Sequence
  X-linked inhibitor of apoptosis (XIAP) siRNA
aagcaattatttttaaaccaacc

SEQ ID NO: 16944 - DNA, 23 bp, Artificial Sequence
  X-linked inhibitor of apoptosis (XIAP) siRNA
agcaattatttttaaaccaacct

SEQ ID NO: 16945 - DNA, 23 bp, Artificial Sequence
  X-linked inhibitor of apoptosis (XIAP) siRNA
gcaattatttttaaaccaaccta

SEQ ID NO: 16946 - DNA, 23 bp, Artificial Sequence
  X-linked inhibitor of apoptosis (XIAP) siRNA
caattatttttaaaccaacctaa

SEQ ID NO: 16947 - DNA, 23 bp, Artificial Sequence
  X-linked inhibitor of apoptosis (XIAP) siRNA
aattatttttaaaccaacctaat

SEQ ID NO: 16948 - DNA, 23 bp, Artificial Sequence
  X-linked inhibitor of apoptosis (XIAP) siRNA
attatttttaaaccaacctaata

SEQ ID NO: 16949 - DNA, 23 bp, Artificial Sequence
  X-linked inhibitor of apoptosis (XIAP) siRNA
ttatttttaaaccaacctaatat

SEQ ID NO: 16950 - DNA, 23 bp, Artificial Sequence
  X-linked inhibitor of apoptosis (XIAP) siRNA
tatttttaaaccaacctaatata

SEQ ID NO: 16951 - DNA, 23 bp, Artificial Sequence
  X-linked inhibitor of apoptosis (XIAP) siRNA
atttttaaaccaacctaatatat

SEQ ID NO: 16952 - DNA, 23 bp, Artificial Sequence
  X-linked inhibitor of apoptosis (XIAP) siRNA
tttttaaaccaacctaatatatt

SEQ ID NO: 16953 - DNA, 23 bp, Artificial Sequence
  X-linked inhibitor of apoptosis (XIAP) siRNA
ttttaaaccaacctaatatattg

SEQ ID NO: 16954 - DNA, 23 bp, Artificial Sequence
  X-linked inhibitor of apoptosis (XIAP) siRNA
tttaaaccaacctaatatattgt

SEQ ID NO: 16955 - DNA, 23 bp, Artificial Sequence
  X-linked inhibitor of apoptosis (XIAP) siRNA
ttaaaccaacctaatatattgta

SEQ ID NO: 16956 - DNA, 23 bp, Artificial Sequence
  X-linked inhibitor of apoptosis (XIAP) siRNA
taaaccaacctaatatattgtat

SEQ ID NO: 16957 - DNA, 23 bp, Artificial Sequence
  X-linked inhibitor of apoptosis (XIAP) siRNA
aaaccaacctaatatattgtatt

SEQ ID NO: 16958 - DNA, 23 bp, Artificial Sequence
  X-linked inhibitor of apoptosis (XIAP) siRNA
aaccaacctaatatattgtatta

SEQ ID NO: 16959 - DNA, 23 bp, Artificial Sequence
  X-linked inhibitor of apoptosis (XIAP) siRNA
accaacctaatatattgtattag

SEQ ID NO: 16960 - DNA, 23 bp, Artificial Sequence
  X-linked inhibitor of apoptosis (XIAP) siRNA
ccaacctaatatattgtattagg

SEQ ID NO: 16961 - DNA, 23 bp, Artificial Sequence
  X-linked inhibitor of apoptosis (XIAP) siRNA
caacctaatatattgtattaggt

SEQ ID NO: 16962 - DNA, 23 bp, Artificial Sequence
  X-linked inhibitor of apoptosis (XIAP) siRNA
aacctaatatattgtattaggta

SEQ ID NO: 16963 - DNA, 23 bp, Artificial Sequence
  X-linked inhibitor of apoptosis (XIAP) siRNA
acctaatatattgtattaggtat

SEQ ID NO: 16964 - DNA, 23 bp, Artificial Sequence
  X-linked inhibitor of apoptosis (XIAP) siRNA
cctaatatattgtattaggtatt

SEQ ID NO: 16965 - DNA, 23 bp, Artificial Sequence
  X-linked inhibitor of apoptosis (XIAP) siRNA
ctaatatattgtattaggtatta

SEQ ID NO: 16966 - DNA, 23 bp, Artificial Sequence
  X-linked inhibitor of apoptosis (XIAP) siRNA
taatatattgtattaggtattaa

SEQ ID NO: 16967 - DNA, 23 bp, Artificial Sequence
  X-linked inhibitor of apoptosis (XIAP) siRNA
aatatattgtattaggtattaaa

SEQ ID NO: 16968 - DNA, 23 bp, Artificial Sequence
  X-linked inhibitor of apoptosis (XIAP) siRNA
atatattgtattaggtattaaag

SEQ ID NO: 16969 - DNA, 23 bp, Artificial Sequence
  X-linked inhibitor of apoptosis (XIAP) siRNA
tatattgtattaggtattaaagt

SEQ ID NO: 16970 - DNA, 23 bp, Artificial Sequence
  X-linked inhibitor of apoptosis (XIAP) siRNA
atattgtattaggtattaaagtc

SEQ ID NO: 16971 - DNA, 23 bp, Artificial Sequence
  X-linked inhibitor of apoptosis (XIAP) siRNA
tattgtattaggtattaaagtca

SEQ ID NO: 16972 - DNA, 23 bp, Artificial Sequence
  X-linked inhibitor of apoptosis (XIAP) siRNA
attgtattaggtattaaagtcat

SEQ ID NO: 16973 - DNA, 23 bp, Artificial Sequence
  X-linked inhibitor of apoptosis (XIAP) siRNA
ttgtattaggtattaaagtcatc

SEQ ID NO: 16974 - DNA, 23 bp, Artificial Sequence
  X-linked inhibitor of apoptosis (XIAP) siRNA
tgtattaggtattaaagtcatct

SEQ ID NO: 16975 - DNA, 23 bp, Artificial Sequence
  X-linked inhibitor of apoptosis (XIAP) siRNA
gtattaggtattaaagtcatctg

SEQ ID NO: 16976 - DNA, 23 bp, Artificial Sequence
  X-linked inhibitor of apoptosis (XIAP) siRNA
tattaggtattaaagtcatctgg

SEQ ID NO: 16977 - DNA, 23 bp, Artificial Sequence
  X-linked inhibitor of apoptosis (XIAP) siRNA
attaggtattaaagtcatctgga

SEQ ID NO: 16978 - DNA, 23 bp, Artificial Sequence
  X-linked inhibitor of apoptosis (XIAP) siRNA
ttaggtattaaagtcatctggac

SEQ ID NO: 16979 - DNA, 23 bp, Artificial Sequence
  X-linked inhibitor of apoptosis (XIAP) siRNA
taggtattaaagtcatctggaca

SEQ ID NO: 16980 - DNA, 23 bp, Artificial Sequence
  X-linked inhibitor of apoptosis (XIAP) siRNA
aggtattaaagtcatctggacat

SEQ ID NO: 16981 - DNA, 23 bp, Artificial Sequence
  X-linked inhibitor of apoptosis (XIAP) siRNA
ggtattaaagtcatctggacatg

SEQ ID NO: 16982 - DNA, 23 bp, Artificial Sequence
  X-linked inhibitor of apoptosis (XIAP) siRNA
gtattaaagtcatctggacatga

SEQ ID NO: 16983 - DNA, 23 bp, Artificial Sequence
  X-linked inhibitor of apoptosis (XIAP) siRNA
tattaaagtcatctggacatgaa

SEQ ID NO: 16984 - DNA, 23 bp, Artificial Sequence
  X-linked inhibitor of apoptosis (XIAP) siRNA
attaaagtcatctggacatgaat

SEQ ID NO: 16985 - DNA, 23 bp, Artificial Sequence
  X-linked inhibitor of apoptosis (XIAP) siRNA
ttaaagtcatctggacatgaatt

SEQ ID NO: 16986 - DNA, 23 bp, Artificial Sequence
  X-linked inhibitor of apoptosis (XIAP) siRNA
taaagtcatctggacatgaatta

SEQ ID NO: 16987 - DNA, 23 bp, Artificial Sequence
  X-linked inhibitor of apoptosis (XIAP) siRNA
aaagtcatctggacatgaattaa

SEQ ID NO: 16988 - DNA, 23 bp, Artificial Sequence
  X-linked inhibitor of apoptosis (XIAP) siRNA
aagtcatctggacatgaattaaa

SEQ ID NO: 16989 - DNA, 23 bp, Artificial Sequence
  X-linked inhibitor of apoptosis (XIAP) siRNA
agtcatctggacatgaattaaag

SEQ ID NO: 16990 - DNA, 23 bp, Artificial Sequence
  X-linked inhibitor of apoptosis (XIAP) siRNA
gtcatctggacatgaattaaagt

SEQ ID NO: 16991 - DNA, 23 bp, Artificial Sequence
  X-linked inhibitor of apoptosis (XIAP) siRNA
tcatctggacatgaattaaagta

SEQ ID NO: 16992 - DNA, 23 bp, Artificial Sequence
  X-linked inhibitor of apoptosis (XIAP) siRNA
catctggacatgaattaaagtat

SEQ ID NO: 16993 - DNA, 23 bp, Artificial Sequence
  X-linked inhibitor of apoptosis (XIAP) siRNA
atctggacatgaattaaagtata

SEQ ID NO: 16994 - DNA, 23 bp, Artificial Sequence
  X-linked inhibitor of apoptosis (XIAP) siRNA
tctggacatgaattaaagtatat

SEQ ID NO: 16995 - DNA, 23 bp, Artificial Sequence
  X-linked inhibitor of apoptosis (XIAP) siRNA
ctggacatgaattaaagtatatg

SEQ ID NO: 16996 - DNA, 23 bp, Artificial Sequence
  X-linked inhibitor of apoptosis (XIAP) siRNA
tggacatgaattaaagtatatga

SEQ ID NO: 16997 - DNA, 23 bp, Artificial Sequence
  X-linked inhibitor of apoptosis (XIAP) siRNA
ggacatgaattaaagtatatgat

SEQ ID NO: 16998 - DNA, 23 bp, Artificial Sequence
  X-linked inhibitor of apoptosis (XIAP) siRNA
gacatgaattaaagtatatgatg

SEQ ID NO: 16999 - DNA, 23 bp, Artificial Sequence
  X-linked inhibitor of apoptosis (XIAP) siRNA
acatgaattaaagtatatgatgc

SEQ ID NO: 17000 - DNA, 23 bp, Artificial Sequence
  X-linked inhibitor of apoptosis (XIAP) siRNA
catgaattaaagtatatgatgcc

SEQ ID NO: 17001 - DNA, 23 bp, Artificial Sequence
  X-linked inhibitor of apoptosis (XIAP) siRNA
atgaattaaagtatatgatgcca

SEQ ID NO: 17002 - DNA, 23 bp, Artificial Sequence
  X-linked inhibitor of apoptosis (XIAP) siRNA
tgaattaaagtatatgatgccag

SEQ ID NO: 17003 - DNA, 23 bp, Artificial Sequence
  X-linked inhibitor of apoptosis (XIAP) siRNA
gaattaaagtatatgatgccagc

SEQ ID NO: 17004 - DNA, 23 bp, Artificial Sequence
  X-linked inhibitor of apoptosis (XIAP) siRNA
aattaaagtatatgatgccagcc

SEQ ID NO: 17005 - DNA, 23 bp, Artificial Sequence
  X-linked inhibitor of apoptosis (XIAP) siRNA
attaaagtatatgatgccagcct

SEQ ID NO: 17006 - DNA, 23 bp, Artificial Sequence
  X-linked inhibitor of apoptosis (XIAP) siRNA
ttaaagtatatgatgccagcctg

SEQ ID NO: 17007 - DNA, 23 bp, Artificial Sequence
  X-linked inhibitor of apoptosis (XIAP) siRNA
taaagtatatgatgccagcctgg

SEQ ID NO: 17008 - DNA, 23 bp, Artificial Sequence
  X-linked inhibitor of apoptosis (XIAP) siRNA
aaagtatatgatgccagcctgga

SEQ ID NO: 17009 - DNA, 23 bp, Artificial Sequence
  X-linked inhibitor of apoptosis (XIAP) siRNA
aagtatatgatgccagcctggac

SEQ ID NO: 17010 - DNA, 23 bp, Artificial Sequence
  X-linked inhibitor of apoptosis (XIAP) siRNA
agtatatgatgccagcctggaca

SEQ ID NO: 17011 - DNA, 23 bp, Artificial Sequence
  X-linked inhibitor of apoptosis (XIAP) siRNA
gtatatgatgccagcctggacaa

SEQ ID NO: 17012 - DNA, 23 bp, Artificial Sequence
  X-linked inhibitor of apoptosis (XIAP) siRNA
tatatgatgccagcctggacaaa

SEQ ID NO: 17013 - DNA, 23 bp, Artificial Sequence
  X-linked inhibitor of apoptosis (XIAP) siRNA
atatgatgccagcctggacaaaa

SEQ ID NO: 17014 - DNA, 23 bp, Artificial Sequence
  X-linked inhibitor of apoptosis (XIAP) siRNA
tatgatgccagcctggacaaaag

SEQ ID NO: 17015 - DNA, 23 bp, Artificial Sequence
  X-linked inhibitor of apoptosis (XIAP) siRNA
atgatgccagcctggacaaaagg

SEQ ID NO: 17016 - DNA, 23 bp, Artificial Sequence
  X-linked inhibitor of apoptosis (XIAP) siRNA
tgatgccagcctggacaaaaggc

SEQ ID NO: 17017 - DNA, 23 bp, Artificial Sequence
  X-linked inhibitor of apoptosis (XIAP) siRNA
gatgccagcctggacaaaaggca

SEQ ID NO: 17018 - DNA, 23 bp, Artificial Sequence
  X-linked inhibitor of apoptosis (XIAP) siRNA
atgccagcctggacaaaaggcaa

SEQ ID NO: 17019 - DNA, 23 bp, Artificial Sequence
  X-linked inhibitor of apoptosis (XIAP) siRNA
tgccagcctggacaaaaggcaaa

SEQ ID NO: 17020 - DNA, 23 bp, Artificial Sequence
  X-linked inhibitor of apoptosis (XIAP) siRNA
gccagcctggacaaaaggcaaaa

SEQ ID NO: 17021 - DNA, 23 bp, Artificial Sequence
  X-linked inhibitor of apoptosis (XIAP) siRNA
ccagcctggacaaaaggcaaaac

SEQ ID NO: 17022 - DNA, 23 bp, Artificial Sequence
  X-linked inhibitor of apoptosis (XIAP) siRNA
cagcctggacaaaaggcaaaacc

SEQ ID NO: 17023 - DNA, 23 bp, Artificial Sequence
  X-linked inhibitor of apoptosis (XIAP) siRNA
agcctggacaaaaggcaaaaccc

SEQ ID NO: 17024 - DNA, 23 bp, Artificial Sequence
  X-linked inhibitor of apoptosis (XIAP) siRNA
gcctggacaaaaggcaaaaccct

SEQ ID NO: 17025 - DNA, 23 bp, Artificial Sequence
  X-linked inhibitor of apoptosis (XIAP) siRNA
cctggacaaaaggcaaaaccctg

SEQ ID NO: 17026 - DNA, 23 bp, Artificial Sequence
  X-linked inhibitor of apoptosis (XIAP) siRNA
ctggacaaaaggcaaaaccctgt

SEQ ID NO: 17027 - DNA, 23 bp, Artificial Sequence
  X-linked inhibitor of apoptosis (XIAP) siRNA
tggacaaaaggcaaaaccctgtc

SEQ ID NO: 17028 - DNA, 23 bp, Artificial Sequence
  X-linked inhibitor of apoptosis (XIAP) siRNA
ggacaaaaggcaaaaccctgtct

SEQ ID NO: 17029 - DNA, 23 bp, Artificial Sequence
  X-linked inhibitor of apoptosis (XIAP) siRNA
gacaaaaggcaaaaccctgtctc

SEQ ID NO: 17030 - DNA, 23 bp, Artificial Sequence
  X-linked inhibitor of apoptosis (XIAP) siRNA
acaaaaggcaaaaccctgtctct

SEQ ID NO: 17031 - DNA, 23 bp, Artificial Sequence
  X-linked inhibitor of apoptosis (XIAP) siRNA
caaaaggcaaaaccctgtctcta

SEQ ID NO: 17032 - DNA, 23 bp, Artificial Sequence
  X-linked inhibitor of apoptosis (XIAP) siRNA
aaaaggcaaaaccctgtctctac

SEQ ID NO: 17033 - DNA, 23 bp, Artificial Sequence
  X-linked inhibitor of apoptosis (XIAP) siRNA
aaaggcaaaaccctgtctctaca

SEQ ID NO: 17034 - DNA, 23 bp, Artificial Sequence
  X-linked inhibitor of apoptosis (XIAP) siRNA
aaggcaaaaccctgtctctacaa

SEQ ID NO: 17035 - DNA, 23 bp, Artificial Sequence
  X-linked inhibitor of apoptosis (XIAP) siRNA
aggcaaaaccctgtctctacaaa

SEQ ID NO: 17036 - DNA, 23 bp, Artificial Sequence
  X-linked inhibitor of apoptosis (XIAP) siRNA
ggcaaaaccctgtctctacaaaa

SEQ ID NO: 17037 - DNA, 23 bp, Artificial Sequence
  X-linked inhibitor of apoptosis (XIAP) siRNA
gcaaaaccctgtctctacaaaaa

SEQ ID NO: 17038 - DNA, 23 bp, Artificial Sequence
  X-linked inhibitor of apoptosis (XIAP) siRNA
caaaaccctgtctctacaaaaaa

SEQ ID NO: 17039 - DNA, 23 bp, Artificial Sequence
  X-linked inhibitor of apoptosis (XIAP) siRNA
aaaaccctgtctctacaaaaaat

SEQ ID NO: 17040 - DNA, 23 bp, Artificial Sequence
  X-linked inhibitor of apoptosis (XIAP) siRNA
aaaccctgtctctacaaaaaata

SEQ ID NO: 17041 - DNA, 23 bp, Artificial Sequence
  X-linked inhibitor of apoptosis (XIAP) siRNA
aaccctgtctctacaaaaaatac

SEQ ID NO: 17042 - DNA, 23 bp, Artificial Sequence
  X-linked inhibitor of apoptosis (XIAP) siRNA
accctgtctctacaaaaaataca

SEQ ID NO: 17043 - DNA, 23 bp, Artificial Sequence
  X-linked inhibitor of apoptosis (XIAP) siRNA
ccctgtctctacaaaaaatacaa

SEQ ID NO: 17044 - DNA, 23 bp, Artificial Sequence
  X-linked inhibitor of apoptosis (XIAP) siRNA
cctgtctctacaaaaaatacaaa

SEQ ID NO: 17045 - DNA, 23 bp, Artificial Sequence
  X-linked inhibitor of apoptosis (XIAP) siRNA
ctgtctctacaaaaaatacaaaa

SEQ ID NO: 17046 - DNA, 23 bp, Artificial Sequence
  X-linked inhibitor of apoptosis (XIAP) siRNA
tgtctctacaaaaaatacaaaaa

SEQ ID NO: 17047 - DNA, 23 bp, Artificial Sequence
  X-linked inhibitor of apoptosis (XIAP) siRNA
gtctctacaaaaaatacaaaaat

SEQ ID NO: 17048 - DNA, 23 bp, Artificial Sequence
  X-linked inhibitor of apoptosis (XIAP) siRNA
tctctacaaaaaatacaaaaatt

SEQ ID NO: 17049 - DNA, 23 bp, Artificial Sequence
  X-linked inhibitor of apoptosis (XIAP) siRNA
ctctacaaaaaatacaaaaatta

SEQ ID NO: 17050 - DNA, 23 bp, Artificial Sequence
  X-linked inhibitor of apoptosis (XIAP) siRNA
tctacaaaaaatacaaaaattag

SEQ ID NO: 17051 - DNA, 23 bp, Artificial Sequence
  X-linked inhibitor of apoptosis (XIAP) siRNA
ctacaaaaaatacaaaaattagc

SEQ ID NO: 17052 - DNA, 23 bp, Artificial Sequence
  X-linked inhibitor of apoptosis (XIAP) siRNA
tacaaaaaatacaaaaattagct

SEQ ID NO: 17053 - DNA, 23 bp, Artificial Sequence
  X-linked inhibitor of apoptosis (XIAP) siRNA
acaaaaaatacaaaaattagctg

SEQ ID NO: 17054 - DNA, 23 bp, Artificial Sequence
  X-linked inhibitor of apoptosis (XIAP) siRNA
caaaaaatacaaaaattagctgg

SEQ ID NO: 17055 - DNA, 23 bp, Artificial Sequence
  X-linked inhibitor of apoptosis (XIAP) siRNA
aaaaaatacaaaaattagctggg

SEQ ID NO: 17056 - DNA, 23 bp, Artificial Sequence
  X-linked inhibitor of apoptosis (XIAP) siRNA
aaaaatacaaaaattagctgggc

SEQ ID NO: 17057 - DNA, 23 bp, Artificial Sequence
  X-linked inhibitor of apoptosis (XIAP) siRNA
aaaatacaaaaattagctgggca

SEQ ID NO: 17058 - DNA, 23 bp, Artificial Sequence
  X-linked inhibitor of apoptosis (XIAP) siRNA
aaatacaaaaattagctgggcat

SEQ ID NO: 17059 - DNA, 23 bp, Artificial Sequence
  X-linked inhibitor of apoptosis (XIAP) siRNA
aatacaaaaattagctgggcatg

SEQ ID NO: 17060 - DNA, 23 bp, Artificial Sequence
  X-linked inhibitor of apoptosis (XIAP) siRNA
atacaaaaattagctgggcatgg

SEQ ID NO: 17061 - DNA, 23 bp, Artificial Sequence
  X-linked inhibitor of apoptosis (XIAP) siRNA
tacaaaaattagctgggcatggt

SEQ ID NO: 17062 - DNA, 23 bp, Artificial Sequence
  X-linked inhibitor of apoptosis (XIAP) siRNA
acaaaaattagctgggcatggtg

SEQ ID NO: 17063 - DNA, 23 bp, Artificial Sequence
  X-linked inhibitor of apoptosis (XIAP) siRNA
caaaaattagctgggcatggtgg

SEQ ID NO: 17064 - DNA, 23 bp, Artificial Sequence
  X-linked inhibitor of apoptosis (XIAP) siRNA
aaaaattagctgggcatggtggt

SEQ ID NO: 17065 - DNA, 23 bp, Artificial Sequence
  X-linked inhibitor of apoptosis (XIAP) siRNA
aaaattagctgggcatggtggtg

SEQ ID NO: 17066 - DNA, 23 bp, Artificial Sequence
  X-linked inhibitor of apoptosis (XIAP) siRNA
aaattagctgggcatggtggtgt

SEQ ID NO: 17067 - DNA, 23 bp, Artificial Sequence
  X-linked inhibitor of apoptosis (XIAP) siRNA
aattagctgggcatggtggtgtg

SEQ ID NO: 17068 - DNA, 23 bp, Artificial Sequence
  X-linked inhibitor of apoptosis (XIAP) siRNA
attagctgggcatggtggtgtgt

SEQ ID NO: 17069 - DNA, 23 bp, Artificial Sequence
  X-linked inhibitor of apoptosis (XIAP) siRNA
ttagctgggcatggtggtgtgtg

SEQ ID NO: 17070 - DNA, 23 bp, Artificial Sequence
  X-linked inhibitor of apoptosis (XIAP) siRNA
tagctgggcatggtggtgtgtgc

SEQ ID NO: 17071 - DNA, 23 bp, Artificial Sequence
  X-linked inhibitor of apoptosis (XIAP) siRNA
agctgggcatggtggtgtgtgcc

SEQ ID NO: 17072 - DNA, 23 bp, Artificial Sequence
  X-linked inhibitor of apoptosis (XIAP) siRNA
gctgggcatggtggtgtgtgcct

SEQ ID NO: 17073 - DNA, 23 bp, Artificial Sequence
  X-linked inhibitor of apoptosis (XIAP) siRNA
ctgggcatggtggtgtgtgcctg

SEQ ID NO: 17074 - DNA, 23 bp, Artificial Sequence
  X-linked inhibitor of apoptosis (XIAP) siRNA
tgggcatggtggtgtgtgcctgt

SEQ ID NO: 17075 - DNA, 23 bp, Artificial Sequence
  X-linked inhibitor of apoptosis (XIAP) siRNA
gggcatggtggtgtgtgcctgta

SEQ ID NO: 17076 - DNA, 23 bp, Artificial Sequence
  X-linked inhibitor of apoptosis (XIAP) siRNA
ggcatggtggtgtgtgcctgtag

SEQ ID NO: 17077 - DNA, 23 bp, Artificial Sequence
  X-linked inhibitor of apoptosis (XIAP) siRNA
gcatggtggtgtgtgcctgtagt

SEQ ID NO: 17078 - DNA, 23 bp, Artificial Sequence
  X-linked inhibitor of apoptosis (XIAP) siRNA
catggtggtgtgtgcctgtagtc

SEQ ID NO: 17079 - DNA, 23 bp, Artificial Sequence
  X-linked inhibitor of apoptosis (XIAP) siRNA
atggtggtgtgtgcctgtagtcc

SEQ ID NO: 17080 - DNA, 23 bp, Artificial Sequence
  X-linked inhibitor of apoptosis (XIAP) siRNA
tggtggtgtgtgcctgtagtcct

SEQ ID NO: 17081 - DNA, 23 bp, Artificial Sequence
  X-linked inhibitor of apoptosis (XIAP) siRNA
ggtggtgtgtgcctgtagtcctg

SEQ ID NO: 17082 - DNA, 23 bp, Artificial Sequence
  X-linked inhibitor of apoptosis (XIAP) siRNA
gtggtgtgtgcctgtagtcctgg

SEQ ID NO: 17083 - DNA, 23 bp, Artificial Sequence
  X-linked inhibitor of apoptosis (XIAP) siRNA
tggtgtgtgcctgtagtcctggc

SEQ ID NO: 17084 - DNA, 23 bp, Artificial Sequence
  X-linked inhibitor of apoptosis (XIAP) siRNA
ggtgtgtgcctgtagtcctggct

SEQ ID NO: 17085 - DNA, 23 bp, Artificial Sequence
  X-linked inhibitor of apoptosis (XIAP) siRNA
gtgtgtgcctgtagtcctggcta

SEQ ID NO: 17086 - DNA, 23 bp, Artificial Sequence
  X-linked inhibitor of apoptosis (XIAP) siRNA
tgtgtgcctgtagtcctggctac

SEQ ID NO: 17087 - DNA, 23 bp, Artificial Sequence
  X-linked inhibitor of apoptosis (XIAP) siRNA
gtgtgcctgtagtcctggctact

SEQ ID NO: 17088 - DNA, 23 bp, Artificial Sequence
  X-linked inhibitor of apoptosis (XIAP) siRNA
tgtgcctgtagtcctggctactc

SEQ ID NO: 17089 - DNA, 23 bp, Artificial Sequence
  X-linked inhibitor of apoptosis (XIAP) siRNA
gtgcctgtagtcctggctactcc

SEQ ID NO: 17090 - DNA, 23 bp, Artificial Sequence
  X-linked inhibitor of apoptosis (XIAP) siRNA
tgcctgtagtcctggctactccg

SEQ ID NO: 17091 - DNA, 23 bp, Artificial Sequence
  X-linked inhibitor of apoptosis (XIAP) siRNA
gcctgtagtcctggctactccgg

SEQ ID NO: 17092 - DNA, 23 bp, Artificial Sequence
  X-linked inhibitor of apoptosis (XIAP) siRNA
cctgtagtcctggctactccgga

SEQ ID NO: 17093 - DNA, 23 bp, Artificial Sequence
  X-linked inhibitor of apoptosis (XIAP) siRNA
ctgtagtcctggctactccggag

SEQ ID NO: 17094 - DNA, 23 bp, Artificial Sequence
  X-linked inhibitor of apoptosis (XIAP) siRNA
tgtagtcctggctactccggagc

SEQ ID NO: 17095 - DNA, 23 bp, Artificial Sequence
  X-linked inhibitor of apoptosis (XIAP) siRNA
gtagtcctggctactccggagcc

SEQ ID NO: 17096 - DNA, 23 bp, Artificial Sequence
  X-linked inhibitor of apoptosis (XIAP) siRNA
tagtcctggctactccggagcct

SEQ ID NO: 17097 - DNA, 23 bp, Artificial Sequence
  X-linked inhibitor of apoptosis (XIAP) siRNA
agtcctggctactccggagcctg

SEQ ID NO: 17098 - DNA, 23 bp, Artificial Sequence
  X-linked inhibitor of apoptosis (XIAP) siRNA
gtcctggctactccggagcctga

SEQ ID NO: 17099 - DNA, 23 bp, Artificial Sequence
  X-linked inhibitor of apoptosis (XIAP) siRNA
tcctggctactccggagcctgag

SEQ ID NO: 17100 - DNA, 23 bp, Artificial Sequence
  X-linked inhibitor of apoptosis (XIAP) siRNA
cctggctactccggagcctgagg

SEQ ID NO: 17101 - DNA, 23 bp, Artificial Sequence
  X-linked inhibitor of apoptosis (XIAP) siRNA
ctggctactccggagcctgaggt

SEQ ID NO: 17102 - DNA, 23 bp, Artificial Sequence
  X-linked inhibitor of apoptosis (XIAP) siRNA
tggctactccggagcctgaggtg

SEQ ID NO: 17103 - DNA, 23 bp, Artificial Sequence
  X-linked inhibitor of apoptosis (XIAP) siRNA
ggctactccggagcctgaggtgg

SEQ ID NO: 17104 - DNA, 23 bp, Artificial Sequence
  X-linked inhibitor of apoptosis (XIAP) siRNA
gctactccggagcctgaggtggg

SEQ ID NO: 17105 - DNA, 23 bp, Artificial Sequence
  X-linked inhibitor of apoptosis (XIAP) siRNA
ctactccggagcctgaggtggga

SEQ ID NO: 17106 - DNA, 23 bp, Artificial Sequence
  X-linked inhibitor of apoptosis (XIAP) siRNA
tactccggagcctgaggtgggag

SEQ ID NO: 17107 - DNA, 23 bp, Artificial Sequence
  X-linked inhibitor of apoptosis (XIAP) siRNA
actccggagcctgaggtgggagg

SEQ ID NO: 17108 - DNA, 23 bp, Artificial Sequence
  X-linked inhibitor of apoptosis (XIAP) siRNA
ctccggagcctgaggtgggagga

SEQ ID NO: 17109 - DNA, 23 bp, Artificial Sequence
  X-linked inhibitor of apoptosis (XIAP) siRNA
tccggagcctgaggtgggaggat

SEQ ID NO: 17110 - DNA, 23 bp, Artificial Sequence
  X-linked inhibitor of apoptosis (XIAP) siRNA
ccggagcctgaggtgggaggatc

SEQ ID NO: 17111 - DNA, 23 bp, Artificial Sequence
  X-linked inhibitor of apoptosis (XIAP) siRNA
cggagcctgaggtgggaggatcg

SEQ ID NO: 17112 - DNA, 23 bp, Artificial Sequence
  X-linked inhibitor of apoptosis (XIAP) siRNA
ggagcctgaggtgggaggatcgc

SEQ ID NO: 17113 - DNA, 23 bp, Artificial Sequence
  X-linked inhibitor of apoptosis (XIAP) siRNA
gagcctgaggtgggaggatcgct

SEQ ID NO: 17114 - DNA, 23 bp, Artificial Sequence
  X-linked inhibitor of apoptosis (XIAP) siRNA
agcctgaggtgggaggatcgctt

SEQ ID NO: 17115 - DNA, 23 bp, Artificial Sequence
  X-linked inhibitor of apoptosis (XIAP) siRNA
gcctgaggtgggaggatcgcttg

SEQ ID NO: 17116 - DNA, 23 bp, Artificial Sequence
  X-linked inhibitor of apoptosis (XIAP) siRNA
cctgaggtgggaggatcgcttga

SEQ ID NO: 17117 - DNA, 23 bp, Artificial Sequence
  X-linked inhibitor of apoptosis (XIAP) siRNA
ctgaggtgggaggatcgcttgag

SEQ ID NO: 17118 - DNA, 23 bp, Artificial Sequence
  X-linked inhibitor of apoptosis (XIAP) siRNA
tgaggtgggaggatcgcttgagt

SEQ ID NO: 17119 - DNA, 23 bp, Artificial Sequence
  X-linked inhibitor of apoptosis (XIAP) siRNA
gaggtgggaggatcgcttgagtc

SEQ ID NO: 17120 - DNA, 23 bp, Artificial Sequence
  X-linked inhibitor of apoptosis (XIAP) siRNA
aggtgggaggatcgcttgagtct

SEQ ID NO: 17121 - DNA, 23 bp, Artificial Sequence
  X-linked inhibitor of apoptosis (XIAP) siRNA
ggtgggaggatcgcttgagtctg

SEQ ID NO: 17122 - DNA, 23 bp, Artificial Sequence
  X-linked inhibitor of apoptosis (XIAP) siRNA
gtgggaggatcgcttgagtctgg

SEQ ID NO: 17123 - DNA, 23 bp, Artificial Sequence
  X-linked inhibitor of apoptosis (XIAP) siRNA
tgggaggatcgcttgagtctggg

SEQ ID NO: 17124 - DNA, 23 bp, Artificial Sequence
  X-linked inhibitor of apoptosis (XIAP) siRNA
gggaggatcgcttgagtctggga

SEQ ID NO: 17125 - DNA, 23 bp, Artificial Sequence
  X-linked inhibitor of apoptosis (XIAP) siRNA
ggaggatcgcttgagtctgggag

SEQ ID NO: 17126 - DNA, 23 bp, Artificial Sequence
  X-linked inhibitor of apoptosis (XIAP) siRNA
gaggatcgcttgagtctgggagg

SEQ ID NO: 17127 - DNA, 23 bp, Artificial Sequence
  X-linked inhibitor of apoptosis (XIAP) siRNA
aggatcgcttgagtctgggaggc

SEQ ID NO: 17128 - DNA, 23 bp, Artificial Sequence
  X-linked inhibitor of apoptosis (XIAP) siRNA
ggatcgcttgagtctgggaggca

SEQ ID NO: 17129 - DNA, 23 bp, Artificial Sequence
  X-linked inhibitor of apoptosis (XIAP) siRNA
gatcgcttgagtctgggaggcag

SEQ ID NO: 17130 - DNA, 23 bp, Artificial Sequence
  X-linked inhibitor of apoptosis (XIAP) siRNA
atcgcttgagtctgggaggcaga

SEQ ID NO: 17131 - DNA, 23 bp, Artificial Sequence
  X-linked inhibitor of apoptosis (XIAP) siRNA
tcgcttgagtctgggaggcagag

SEQ ID NO: 17132 - DNA, 23 bp, Artificial Sequence
  X-linked inhibitor of apoptosis (XIAP) siRNA
cgcttgagtctgggaggcagagg

SEQ ID NO: 17133 - DNA, 23 bp, Artificial Sequence
  X-linked inhibitor of apoptosis (XIAP) siRNA
gcttgagtctgggaggcagaggc

SEQ ID NO: 17134 - DNA, 23 bp, Artificial Sequence
  X-linked inhibitor of apoptosis (XIAP) siRNA
cttgagtctgggaggcagaggct

SEQ ID NO: 17135 - DNA, 23 bp, Artificial Sequence
  X-linked inhibitor of apoptosis (XIAP) siRNA
ttgagtctgggaggcagaggctg

SEQ ID NO: 17136 - DNA, 23 bp, Artificial Sequence
  X-linked inhibitor of apoptosis (XIAP) siRNA
tgagtctgggaggcagaggctgc

SEQ ID NO: 17137 - DNA, 23 bp, Artificial Sequence
  X-linked inhibitor of apoptosis (XIAP) siRNA
gagtctgggaggcagaggctgca

SEQ ID NO: 17138 - DNA, 23 bp, Artificial Sequence
  X-linked inhibitor of apoptosis (XIAP) siRNA
agtctgggaggcagaggctgcat

SEQ ID NO: 17139 - DNA, 23 bp, Artificial Sequence
  X-linked inhibitor of apoptosis (XIAP) siRNA
gtctgggaggcagaggctgcatt

SEQ ID NO: 17140 - DNA, 23 bp, Artificial Sequence
  X-linked inhibitor of apoptosis (XIAP) siRNA
tctgggaggcagaggctgcattg

SEQ ID NO: 17141 - DNA, 23 bp, Artificial Sequence
  X-linked inhibitor of apoptosis (XIAP) siRNA
ctgggaggcagaggctgcattga

SEQ ID NO: 17142 - DNA, 23 bp, Artificial Sequence
  X-linked inhibitor of apoptosis (XIAP) siRNA
tgggaggcagaggctgcattgag

SEQ ID NO: 17143 - DNA, 23 bp, Artificial Sequence
  X-linked inhibitor of apoptosis (XIAP) siRNA
gggaggcagaggctgcattgagc

SEQ ID NO: 17144 - DNA, 23 bp, Artificial Sequence
  X-linked inhibitor of apoptosis (XIAP) siRNA
ggaggcagaggctgcattgagct

SEQ ID NO: 17145 - DNA, 23 bp, Artificial Sequence
  X-linked inhibitor of apoptosis (XIAP) siRNA
gaggcagaggctgcattgagcta

SEQ ID NO: 17146 - DNA, 23 bp, Artificial Sequence
  X-linked inhibitor of apoptosis (XIAP) siRNA
aggcagaggctgcattgagctat

SEQ ID NO: 17147 - DNA, 23 bp, Artificial Sequence
  X-linked inhibitor of apoptosis (XIAP) siRNA
ggcagaggctgcattgagctatg

SEQ ID NO: 17148 - DNA, 23 bp, Artificial Sequence
  X-linked inhibitor of apoptosis (XIAP) siRNA
gcagaggctgcattgagctatga

SEQ ID NO: 17149 - DNA, 23 bp, Artificial Sequence
  X-linked inhibitor of apoptosis (XIAP) siRNA
cagaggctgcattgagctatgat

SEQ ID NO: 17150 - DNA, 23 bp, Artificial Sequence
  X-linked inhibitor of apoptosis (XIAP) siRNA
agaggctgcattgagctatgatc

SEQ ID NO: 17151 - DNA, 23 bp, Artificial Sequence
  X-linked inhibitor of apoptosis (XIAP) siRNA
gaggctgcattgagctatgatca

SEQ ID NO: 17152 - DNA, 23 bp, Artificial Sequence
  X-linked inhibitor of apoptosis (XIAP) siRNA
aggctgcattgagctatgatcat

SEQ ID NO: 17153 - DNA, 23 bp, Artificial Sequence
  X-linked inhibitor of apoptosis (XIAP) siRNA
ggctgcattgagctatgatcatg

SEQ ID NO: 17154 - DNA, 23 bp, Artificial Sequence
  X-linked inhibitor of apoptosis (XIAP) siRNA
gctgcattgagctatgatcatgg

SEQ ID NO: 17155 - DNA, 23 bp, Artificial Sequence
  X-linked inhibitor of apoptosis (XIAP) siRNA
ctgcattgagctatgatcatggc

SEQ ID NO: 17156 - DNA, 23 bp, Artificial Sequence
  X-linked inhibitor of apoptosis (XIAP) siRNA
tgcattgagctatgatcatggca

SEQ ID NO: 17157 - DNA, 23 bp, Artificial Sequence
  X-linked inhibitor of apoptosis (XIAP) siRNA
gcattgagctatgatcatggcac

SEQ ID NO: 17158 - DNA, 23 bp, Artificial Sequence
  X-linked inhibitor of apoptosis (XIAP) siRNA
cattgagctatgatcatggcact

SEQ ID NO: 17159 - DNA, 23 bp, Artificial Sequence
  X-linked inhibitor of apoptosis (XIAP) siRNA
attgagctatgatcatggcactg

SEQ ID NO: 17160 - DNA, 23 bp, Artificial Sequence
  X-linked inhibitor of apoptosis (XIAP) siRNA
ttgagctatgatcatggcactgc

SEQ ID NO: 17161 - DNA, 23 bp, Artificial Sequence
  X-linked inhibitor of apoptosis (XIAP) siRNA
tgagctatgatcatggcactgca

SEQ ID NO: 17162 - DNA, 23 bp, Artificial Sequence
  X-linked inhibitor of apoptosis (XIAP) siRNA
gagctatgatcatggcactgcat

SEQ ID NO: 17163 - DNA, 23 bp, Artificial Sequence
  X-linked inhibitor of apoptosis (XIAP) siRNA
agctatgatcatggcactgcatt

SEQ ID NO: 17164 - DNA, 23 bp, Artificial Sequence
  X-linked inhibitor of apoptosis (XIAP) siRNA
gctatgatcatggcactgcattc

SEQ ID NO: 17165 - DNA, 23 bp, Artificial Sequence
  X-linked inhibitor of apoptosis (XIAP) siRNA
ctatgatcatggcactgcattcc

SEQ ID NO: 17166 - DNA, 23 bp, Artificial Sequence
  X-linked inhibitor of apoptosis (XIAP) siRNA
tatgatcatggcactgcattcca

SEQ ID NO: 17167 - DNA, 23 bp, Artificial Sequence
  X-linked inhibitor of apoptosis (XIAP) siRNA
atgatcatggcactgcattccag

SEQ ID NO: 17168 - DNA, 23 bp, Artificial Sequence
  X-linked inhibitor of apoptosis (XIAP) siRNA
tgatcatggcactgcattccagc

SEQ ID NO: 17169 - DNA, 23 bp, Artificial Sequence
  X-linked inhibitor of apoptosis (XIAP) siRNA
gatcatggcactgcattccagcc

SEQ ID NO: 17170 - DNA, 23 bp, Artificial Sequence
  X-linked inhibitor of apoptosis (XIAP) siRNA
atcatggcactgcattccagcct

SEQ ID NO: 17171 - DNA, 23 bp, Artificial Sequence
  X-linked inhibitor of apoptosis (XIAP) siRNA
tcatggcactgcattccagcctg

SEQ ID NO: 17172 - DNA, 23 bp, Artificial Sequence
  X-linked inhibitor of apoptosis (XIAP) siRNA
catggcactgcattccagcctgg

SEQ ID NO: 17173 - DNA, 23 bp, Artificial Sequence
  X-linked inhibitor of apoptosis (XIAP) siRNA
atggcactgcattccagcctggg

SEQ ID NO: 17174 - DNA, 23 bp, Artificial Sequence
  X-linked inhibitor of apoptosis (XIAP) siRNA
tggcactgcattccagcctgggt

SEQ ID NO: 17175 - DNA, 23 bp, Artificial Sequence
  X-linked inhibitor of apoptosis (XIAP) siRNA
ggcactgcattccagcctgggtg

SEQ ID NO: 17176 - DNA, 23 bp, Artificial Sequence
  X-linked inhibitor of apoptosis (XIAP) siRNA
gcactgcattccagcctgggtga

SEQ ID NO: 17177 - DNA, 23 bp, Artificial Sequence
  X-linked inhibitor of apoptosis (XIAP) siRNA
cactgcattccagcctgggtgac

SEQ ID NO: 17178 - DNA, 23 bp, Artificial Sequence
  X-linked inhibitor of apoptosis (XIAP) siRNA
actgcattccagcctgggtgaca

SEQ ID NO: 17179 - DNA, 23 bp, Artificial Sequence
  X-linked inhibitor of apoptosis (XIAP) siRNA
ctgcattccagcctgggtgacag

SEQ ID NO: 17180 - DNA, 23 bp, Artificial Sequence
  X-linked inhibitor of apoptosis (XIAP) siRNA
tgcattccagcctgggtgacagt

SEQ ID NO: 17181 - DNA, 23 bp, Artificial Sequence
  X-linked inhibitor of apoptosis (XIAP) siRNA
gcattccagcctgggtgacagtg

SEQ ID NO: 17182 - DNA, 23 bp, Artificial Sequence
  X-linked inhibitor of apoptosis (XIAP) siRNA
cattccagcctgggtgacagtgc

SEQ ID NO: 17183 - DNA, 23 bp, Artificial Sequence
  X-linked inhibitor of apoptosis (XIAP) siRNA
attccagcctgggtgacagtgca

SEQ ID NO: 17184 - DNA, 23 bp, Artificial Sequence
  X-linked inhibitor of apoptosis (XIAP) siRNA
ttccagcctgggtgacagtgcaa

SEQ ID NO: 17185 - DNA, 23 bp, Artificial Sequence
  X-linked inhibitor of apoptosis (XIAP) siRNA
tccagcctgggtgacagtgcaag

SEQ ID NO: 17186 - DNA, 23 bp, Artificial Sequence
  X-linked inhibitor of apoptosis (XIAP) siRNA
ccagcctgggtgacagtgcaaga

SEQ ID NO: 17187 - DNA, 23 bp, Artificial Sequence
  X-linked inhibitor of apoptosis (XIAP) siRNA
cagcctgggtgacagtgcaagac

SEQ ID NO: 17188 - DNA, 23 bp, Artificial Sequence
  X-linked inhibitor of apoptosis (XIAP) siRNA
agcctgggtgacagtgcaagacc

SEQ ID NO: 17189 - DNA, 23 bp, Artificial Sequence
  X-linked inhibitor of apoptosis (XIAP) siRNA
gcctgggtgacagtgcaagacct

SEQ ID NO: 17190 - DNA, 23 bp, Artificial Sequence
  X-linked inhibitor of apoptosis (XIAP) siRNA
cctgggtgacagtgcaagacctt

SEQ ID NO: 17191 - DNA, 23 bp, Artificial Sequence
  X-linked inhibitor of apoptosis (XIAP) siRNA
ctgggtgacagtgcaagaccttg

SEQ ID NO: 17192 - DNA, 23 bp, Artificial Sequence
  X-linked inhibitor of apoptosis (XIAP) siRNA
tgggtgacagtgcaagaccttgt

SEQ ID NO: 17193 - DNA, 23 bp, Artificial Sequence
  X-linked inhibitor of apoptosis (XIAP) siRNA
gggtgacagtgcaagaccttgtc

SEQ ID NO: 17194 - DNA, 23 bp, Artificial Sequence
  X-linked inhibitor of apoptosis (XIAP) siRNA
ggtgacagtgcaagaccttgtct

SEQ ID NO: 17195 - DNA, 23 bp, Artificial Sequence
  X-linked inhibitor of apoptosis (XIAP) siRNA
gtgacagtgcaagaccttgtctc

SEQ ID NO: 17196 - DNA, 23 bp, Artificial Sequence
  X-linked inhibitor of apoptosis (XIAP) siRNA
tgacagtgcaagaccttgtctca

SEQ ID NO: 17197 - DNA, 23 bp, Artificial Sequence
  X-linked inhibitor of apoptosis (XIAP) siRNA
gacagtgcaagaccttgtctcag

SEQ ID NO: 17198 - DNA, 23 bp, Artificial Sequence
  X-linked inhibitor of apoptosis (XIAP) siRNA
acagtgcaagaccttgtctcaga

SEQ ID NO: 17199 - DNA, 23 bp, Artificial Sequence
  X-linked inhibitor of apoptosis (XIAP) siRNA
cagtgcaagaccttgtctcagaa

SEQ ID NO: 17200 - DNA, 23 bp, Artificial Sequence
  X-linked inhibitor of apoptosis (XIAP) siRNA
agtgcaagaccttgtctcagaat

SEQ ID NO: 17201 - DNA, 23 bp, Artificial Sequence
  X-linked inhibitor of apoptosis (XIAP) siRNA
gtgcaagaccttgtctcagaata

SEQ ID NO: 17202 - DNA, 23 bp, Artificial Sequence
  X-linked inhibitor of apoptosis (XIAP) siRNA
tgcaagaccttgtctcagaataa

SEQ ID NO: 17203 - DNA, 23 bp, Artificial Sequence
  X-linked inhibitor of apoptosis (XIAP) siRNA
gcaagaccttgtctcagaataaa

SEQ ID NO: 17204 - DNA, 23 bp, Artificial Sequence
  X-linked inhibitor of apoptosis (XIAP) siRNA
caagaccttgtctcagaataaat

SEQ ID NO: 17205 - DNA, 23 bp, Artificial Sequence
  X-linked inhibitor of apoptosis (XIAP) siRNA
aagaccttgtctcagaataaata

SEQ ID NO: 17206 - DNA, 23 bp, Artificial Sequence
  X-linked inhibitor of apoptosis (XIAP) siRNA
agaccttgtctcagaataaataa

SEQ ID NO: 17207 - DNA, 23 bp, Artificial Sequence
  X-linked inhibitor of apoptosis (XIAP) siRNA
gaccttgtctcagaataaataaa

SEQ ID NO: 17208 - DNA, 23 bp, Artificial Sequence
  X-linked inhibitor of apoptosis (XIAP) siRNA
accttgtctcagaataaataaag

SEQ ID NO: 17209 - DNA, 23 bp, Artificial Sequence
  X-linked inhibitor of apoptosis (XIAP) siRNA
ccttgtctcagaataaataaagt

SEQ ID NO: 17210 - DNA, 23 bp, Artificial Sequence
  X-linked inhibitor of apoptosis (XIAP) siRNA
cttgtctcagaataaataaagta

SEQ ID NO: 17211 - DNA, 23 bp, Artificial Sequence
  X-linked inhibitor of apoptosis (XIAP) siRNA
ttgtctcagaataaataaagtat

SEQ ID NO: 17212 - DNA, 23 bp, Artificial Sequence
  X-linked inhibitor of apoptosis (XIAP) siRNA
tgtctcagaataaataaagtatg

SEQ ID NO: 17213 - DNA, 23 bp, Artificial Sequence
  X-linked inhibitor of apoptosis (XIAP) siRNA
gtctcagaataaataaagtatgt

SEQ ID NO: 17214 - DNA, 23 bp, Artificial Sequence
  X-linked inhibitor of apoptosis (XIAP) siRNA
tctcagaataaataaagtatgtg

SEQ ID NO: 17215 - DNA, 23 bp, Artificial Sequence
  X-linked inhibitor of apoptosis (XIAP) siRNA
ctcagaataaataaagtatgtga

SEQ ID NO: 17216 - DNA, 23 bp, Artificial Sequence
  X-linked inhibitor of apoptosis (XIAP) siRNA
tcagaataaataaagtatgtgat

SEQ ID NO: 17217 - DNA, 23 bp, Artificial Sequence
  X-linked inhibitor of apoptosis (XIAP) siRNA
cagaataaataaagtatgtgatg

SEQ ID NO: 17218 - DNA, 23 bp, Artificial Sequence
  X-linked inhibitor of apoptosis (XIAP) siRNA
agaataaataaagtatgtgatga

SEQ ID NO: 17219 - DNA, 23 bp, Artificial Sequence
  X-linked inhibitor of apoptosis (XIAP) siRNA
gaataaataaagtatgtgatgaa

SEQ ID NO: 17220 - DNA, 23 bp, Artificial Sequence
  X-linked inhibitor of apoptosis (XIAP) siRNA
aataaataaagtatgtgatgaag

SEQ ID NO: 17221 - DNA, 23 bp, Artificial Sequence
  X-linked inhibitor of apoptosis (XIAP) siRNA
ataaataaagtatgtgatgaaga

SEQ ID NO: 17222 - DNA, 23 bp, Artificial Sequence
  X-linked inhibitor of apoptosis (XIAP) siRNA
taaataaagtatgtgatgaagat

SEQ ID NO: 17223 - DNA, 23 bp, Artificial Sequence
  X-linked inhibitor of apoptosis (XIAP) siRNA
aaataaagtatgtgatgaagatg

SEQ ID NO: 17224 - DNA, 23 bp, Artificial Sequence
  X-linked inhibitor of apoptosis (XIAP) siRNA
aataaagtatgtgatgaagatgt

SEQ ID NO: 17225 - DNA, 23 bp, Artificial Sequence
  X-linked inhibitor of apoptosis (XIAP) siRNA
ataaagtatgtgatgaagatgtg

SEQ ID NO: 17226 - DNA, 23 bp, Artificial Sequence
  X-linked inhibitor of apoptosis (XIAP) siRNA
taaagtatgtgatgaagatgtgc

SEQ ID NO: 17227 - DNA, 23 bp, Artificial Sequence
  X-linked inhibitor of apoptosis (XIAP) siRNA
aaagtatgtgatgaagatgtgca

SEQ ID NO: 17228 - DNA, 23 bp, Artificial Sequence
  X-linked inhibitor of apoptosis (XIAP) siRNA
aagtatgtgatgaagatgtgcat

SEQ ID NO: 17229 - DNA, 23 bp, Artificial Sequence
  X-linked inhibitor of apoptosis (XIAP) siRNA
agtatgtgatgaagatgtgcata

SEQ ID NO: 17230 - DNA, 23 bp, Artificial Sequence
  X-linked inhibitor of apoptosis (XIAP) siRNA
gtatgtgatgaagatgtgcatac

SEQ ID NO: 17231 - DNA, 23 bp, Artificial Sequence
  X-linked inhibitor of apoptosis (XIAP) siRNA
tatgtgatgaagatgtgcataca

SEQ ID NO: 17232 - DNA, 23 bp, Artificial Sequence
  X-linked inhibitor of apoptosis (XIAP) siRNA
atgtgatgaagatgtgcatacat

SEQ ID NO: 17233 - DNA, 23 bp, Artificial Sequence
  X-linked inhibitor of apoptosis (XIAP) siRNA
tgtgatgaagatgtgcatacatt

SEQ ID NO: 17234 - DNA, 23 bp, Artificial Sequence
  X-linked inhibitor of apoptosis (XIAP) siRNA
gtgatgaagatgtgcatacatta

SEQ ID NO: 17235 - DNA, 23 bp, Artificial Sequence
  X-linked inhibitor of apoptosis (XIAP) siRNA
tgatgaagatgtgcatacattat

SEQ ID NO: 17236 - DNA, 23 bp, Artificial Sequence
  X-linked inhibitor of apoptosis (XIAP) siRNA
gatgaagatgtgcatacattata

SEQ ID NO: 17237 - DNA, 23 bp, Artificial Sequence
  X-linked inhibitor of apoptosis (XIAP) siRNA
atgaagatgtgcatacattatat

SEQ ID NO: 17238 - DNA, 23 bp, Artificial Sequence
  X-linked inhibitor of apoptosis (XIAP) siRNA
tgaagatgtgcatacattatatg

SEQ ID NO: 17239 - DNA, 23 bp, Artificial Sequence
  X-linked inhibitor of apoptosis (XIAP) siRNA
gaagatgtgcatacattatatgc

SEQ ID NO: 17240 - DNA, 23 bp, Artificial Sequence
  X-linked inhibitor of apoptosis (XIAP) siRNA
aagatgtgcatacattatatgca

SEQ ID NO: 17241 - DNA, 23 bp, Artificial Sequence
  X-linked inhibitor of apoptosis (XIAP) siRNA
agatgtgcatacattatatgcaa

SEQ ID NO: 17242 - DNA, 23 bp, Artificial Sequence
  X-linked inhibitor of apoptosis (XIAP) siRNA
gatgtgcatacattatatgcaaa

SEQ ID NO: 17243 - DNA, 23 bp, Artificial Sequence
  X-linked inhibitor of apoptosis (XIAP) siRNA
atgtgcatacattatatgcaaat

SEQ ID NO: 17244 - DNA, 23 bp, Artificial Sequence
  X-linked inhibitor of apoptosis (XIAP) siRNA
tgtgcatacattatatgcaaata

SEQ ID NO: 17245 - DNA, 23 bp, Artificial Sequence
  X-linked inhibitor of apoptosis (XIAP) siRNA
gtgcatacattatatgcaaatac

SEQ ID NO: 17246 - DNA, 23 bp, Artificial Sequence
  X-linked inhibitor of apoptosis (XIAP) siRNA
tgcatacattatatgcaaatact

SEQ ID NO: 17247 - DNA, 23 bp, Artificial Sequence
  X-linked inhibitor of apoptosis (XIAP) siRNA
gcatacattatatgcaaatactg

SEQ ID NO: 17248 - DNA, 23 bp, Artificial Sequence
  X-linked inhibitor of apoptosis (XIAP) siRNA
catacattatatgcaaatactgt

SEQ ID NO: 17249 - DNA, 23 bp, Artificial Sequence
  X-linked inhibitor of apoptosis (XIAP) siRNA
atacattatatgcaaatactgtt

SEQ ID NO: 17250 - DNA, 23 bp, Artificial Sequence
  X-linked inhibitor of apoptosis (XIAP) siRNA
tacattatatgcaaatactgttt

SEQ ID NO: 17251 - DNA, 23 bp, Artificial Sequence
  X-linked inhibitor of apoptosis (XIAP) siRNA
acattatatgcaaatactgtttt

SEQ ID NO: 17252 - DNA, 23 bp, Artificial Sequence
  X-linked inhibitor of apoptosis (XIAP) siRNA
cattatatgcaaatactgttttt

SEQ ID NO: 17253 - DNA, 23 bp, Artificial Sequence
  X-linked inhibitor of apoptosis (XIAP) siRNA
attatatgcaaatactgtttttt

SEQ ID NO: 17254 - DNA, 23 bp, Artificial Sequence
  X-linked inhibitor of apoptosis (XIAP) siRNA
ttatatgcaaatactgttttttt

SEQ ID NO: 17255 - DNA, 23 bp, Artificial Sequence
  X-linked inhibitor of apoptosis (XIAP) siRNA
tatatgcaaatactgtttttttt

SEQ ID NO: 17256 - DNA, 23 bp, Artificial Sequence
  X-linked inhibitor of apoptosis (XIAP) siRNA
ttttttttaatttaaacagtctc

SEQ ID NO: 17257 - DNA, 23 bp, Artificial Sequence
  X-linked inhibitor of apoptosis (XIAP) siRNA
tttttttaatttaaacagtctca

SEQ ID NO: 17258 - DNA, 23 bp, Artificial Sequence
  X-linked inhibitor of apoptosis (XIAP) siRNA
ttttttaatttaaacagtctcac

SEQ ID NO: 17259 - DNA, 23 bp, Artificial Sequence
  X-linked inhibitor of apoptosis (XIAP) siRNA
tttttaatttaaacagtctcact

SEQ ID NO: 17260 - DNA, 23 bp, Artificial Sequence
  X-linked inhibitor of apoptosis (XIAP) siRNA
ttttaatttaaacagtctcactg

SEQ ID NO: 17261 - DNA, 23 bp, Artificial Sequence
  X-linked inhibitor of apoptosis (XIAP) siRNA
tttaatttaaacagtctcactgt

SEQ ID NO: 17262 - DNA, 23 bp, Artificial Sequence
  X-linked inhibitor of apoptosis (XIAP) siRNA
ttaatttaaacagtctcactgtg

SEQ ID NO: 17263 - DNA, 23 bp, Artificial Sequence
  X-linked inhibitor of apoptosis (XIAP) siRNA
taatttaaacagtctcactgtgt

SEQ ID NO: 17264 - DNA, 23 bp, Artificial Sequence
  X-linked inhibitor of apoptosis (XIAP) siRNA
aatttaaacagtctcactgtgtt

SEQ ID NO: 17265 - DNA, 23 bp, Artificial Sequence
  X-linked inhibitor of apoptosis (XIAP) siRNA
atttaaacagtctcactgtgttg

SEQ ID NO: 17266 - DNA, 23 bp, Artificial Sequence
  X-linked inhibitor of apoptosis (XIAP) siRNA
tttaaacagtctcactgtgttgc

SEQ ID NO: 17267 - DNA, 23 bp, Artificial Sequence
  X-linked inhibitor of apoptosis (XIAP) siRNA
ttaaacagtctcactgtgttgcc

SEQ ID NO: 17268 - DNA, 23 bp, Artificial Sequence
  X-linked inhibitor of apoptosis (XIAP) siRNA
taaacagtctcactgtgttgccc

SEQ ID NO: 17269 - DNA, 23 bp, Artificial Sequence
  X-linked inhibitor of apoptosis (XIAP) siRNA
aaacagtctcactgtgttgccca

SEQ ID NO: 17270 - DNA, 23 bp, Artificial Sequence
  X-linked inhibitor of apoptosis (XIAP) siRNA
aacagtctcactgtgttgcccag

SEQ ID NO: 17271 - DNA, 23 bp, Artificial Sequence
  X-linked inhibitor of apoptosis (XIAP) siRNA
acagtctcactgtgttgcccagg

SEQ ID NO: 17272 - DNA, 23 bp, Artificial Sequence
  X-linked inhibitor of apoptosis (XIAP) siRNA
cagtctcactgtgttgcccagga

SEQ ID NO: 17273 - DNA, 23 bp, Artificial Sequence
  X-linked inhibitor of apoptosis (XIAP) siRNA
agtctcactgtgttgcccaggat

SEQ ID NO: 17274 - DNA, 23 bp, Artificial Sequence
  X-linked inhibitor of apoptosis (XIAP) siRNA
gtctcactgtgttgcccaggatg

SEQ ID NO: 17275 - DNA, 23 bp, Artificial Sequence
  X-linked inhibitor of apoptosis (XIAP) siRNA
tctcactgtgttgcccaggatgg

SEQ ID NO: 17276 - DNA, 23 bp, Artificial Sequence
  X-linked inhibitor of apoptosis (XIAP) siRNA
ctcactgtgttgcccaggatgga

SEQ ID NO: 17277 - DNA, 23 bp, Artificial Sequence
  X-linked inhibitor of apoptosis (XIAP) siRNA
tcactgtgttgcccaggatggag

SEQ ID NO: 17278 - DNA, 23 bp, Artificial Sequence
  X-linked inhibitor of apoptosis (XIAP) siRNA
cactgtgttgcccaggatggagt

SEQ ID NO: 17279 - DNA, 23 bp, Artificial Sequence
  X-linked inhibitor of apoptosis (XIAP) siRNA
actgtgttgcccaggatggagtg

SEQ ID NO: 17280 - DNA, 23 bp, Artificial Sequence
  X-linked inhibitor of apoptosis (XIAP) siRNA
ctgtgttgcccaggatggagtgc

SEQ ID NO: 17281 - DNA, 23 bp, Artificial Sequence
  X-linked inhibitor of apoptosis (XIAP) siRNA
tgtgttgcccaggatggagtgca

SEQ ID NO: 17282 - DNA, 23 bp, Artificial Sequence
  X-linked inhibitor of apoptosis (XIAP) siRNA
gtgttgcccaggatggagtgcaa

SEQ ID NO: 17283 - DNA, 23 bp, Artificial Sequence
  X-linked inhibitor of apoptosis (XIAP) siRNA
tgttgcccaggatggagtgcaat

SEQ ID NO: 17284 - DNA, 23 bp, Artificial Sequence
  X-linked inhibitor of apoptosis (XIAP) siRNA
gttgcccaggatggagtgcaatg

SEQ ID NO: 17285 - DNA, 23 bp, Artificial Sequence
  X-linked inhibitor of apoptosis (XIAP) siRNA
ttgcccaggatggagtgcaatgg

SEQ ID NO: 17286 - DNA, 23 bp, Artificial Sequence
  X-linked inhibitor of apoptosis (XIAP) siRNA
tgcccaggatggagtgcaatggc

SEQ ID NO: 17287 - DNA, 23 bp, Artificial Sequence
  X-linked inhibitor of apoptosis (XIAP) siRNA
gcccaggatggagtgcaatggca

SEQ ID NO: 17288 - DNA, 23 bp, Artificial Sequence
  X-linked inhibitor of apoptosis (XIAP) siRNA
cccaggatggagtgcaatggcac

SEQ ID NO: 17289 - DNA, 23 bp, Artificial Sequence
  X-linked inhibitor of apoptosis (XIAP) siRNA
ccaggatggagtgcaatggcaca

SEQ ID NO: 17290 - DNA, 23 bp, Artificial Sequence
  X-linked inhibitor of apoptosis (XIAP) siRNA
caggatggagtgcaatggcacaa

SEQ ID NO: 17291 - DNA, 23 bp, Artificial Sequence
  X-linked inhibitor of apoptosis (XIAP) siRNA
aggatggagtgcaatggcacaat

SEQ ID NO: 17292 - DNA, 23 bp, Artificial Sequence
  X-linked inhibitor of apoptosis (XIAP) siRNA
ggatggagtgcaatggcacaatc

SEQ ID NO: 17293 - DNA, 23 bp, Artificial Sequence
  X-linked inhibitor of apoptosis (XIAP) siRNA
gatggagtgcaatggcacaatct

SEQ ID NO: 17294 - DNA, 23 bp, Artificial Sequence
  X-linked inhibitor of apoptosis (XIAP) siRNA
atggagtgcaatggcacaatctt

SEQ ID NO: 17295 - DNA, 23 bp, Artificial Sequence
  X-linked inhibitor of apoptosis (XIAP) siRNA
tggagtgcaatggcacaatcttg

SEQ ID NO: 17296 - DNA, 23 bp, Artificial Sequence
  X-linked inhibitor of apoptosis (XIAP) siRNA
ggagtgcaatggcacaatcttgg

SEQ ID NO: 17297 - DNA, 23 bp, Artificial Sequence
  X-linked inhibitor of apoptosis (XIAP) siRNA
gagtgcaatggcacaatcttggc

SEQ ID NO: 17298 - DNA, 23 bp, Artificial Sequence
  X-linked inhibitor of apoptosis (XIAP) siRNA
agtgcaatggcacaatcttggct

SEQ ID NO: 17299 - DNA, 23 bp, Artificial Sequence
  X-linked inhibitor of apoptosis (XIAP) siRNA
gtgcaatggcacaatcttggctc

SEQ ID NO: 17300 - DNA, 23 bp, Artificial Sequence
  X-linked inhibitor of apoptosis (XIAP) siRNA
tgcaatggcacaatcttggctca

SEQ ID NO: 17301 - DNA, 23 bp, Artificial Sequence
  X-linked inhibitor of apoptosis (XIAP) siRNA
gcaatggcacaatcttggctcat

SEQ ID NO: 17302 - DNA, 23 bp, Artificial Sequence
  X-linked inhibitor of apoptosis (XIAP) siRNA
caatggcacaatcttggctcatg

SEQ ID NO: 17303 - DNA, 23 bp, Artificial Sequence
  X-linked inhibitor of apoptosis (XIAP) siRNA
aatggcacaatcttggctcatgg

SEQ ID NO: 17304 - DNA, 23 bp, Artificial Sequence
  X-linked inhibitor of apoptosis (XIAP) siRNA
atggcacaatcttggctcatggc

SEQ ID NO: 17305 - DNA, 23 bp, Artificial Sequence
  X-linked inhibitor of apoptosis (XIAP) siRNA
tggcacaatcttggctcatggca

SEQ ID NO: 17306 - DNA, 23 bp, Artificial Sequence
  X-linked inhibitor of apoptosis (XIAP) siRNA
ggcacaatcttggctcatggcaa

SEQ ID NO: 17307 - DNA, 23 bp, Artificial Sequence
  X-linked inhibitor of apoptosis (XIAP) siRNA
gcacaatcttggctcatggcaaa

SEQ ID NO: 17308 - DNA, 23 bp, Artificial Sequence
  X-linked inhibitor of apoptosis (XIAP) siRNA
cacaatcttggctcatggcaaac

SEQ ID NO: 17309 - DNA, 23 bp, Artificial Sequence
  X-linked inhibitor of apoptosis (XIAP) siRNA
acaatcttggctcatggcaaact

SEQ ID NO: 17310 - DNA, 23 bp, Artificial Sequence
  X-linked inhibitor of apoptosis (XIAP) siRNA
caatcttggctcatggcaaactc

SEQ ID NO: 17311 - DNA, 23 bp, Artificial Sequence
  X-linked inhibitor of apoptosis (XIAP) siRNA
aatcttggctcatggcaaactct

SEQ ID NO: 17312 - DNA, 23 bp, Artificial Sequence
  X-linked inhibitor of apoptosis (XIAP) siRNA
atcttggctcatggcaaactctg

SEQ ID NO: 17313 - DNA, 23 bp, Artificial Sequence
  X-linked inhibitor of apoptosis (XIAP) siRNA
tcttggctcatggcaaactctgc

SEQ ID NO: 17314 - DNA, 23 bp, Artificial Sequence
  X-linked inhibitor of apoptosis (XIAP) siRNA
cttggctcatggcaaactctgcc

SEQ ID NO: 17315 - DNA, 23 bp, Artificial Sequence
  X-linked inhibitor of apoptosis (XIAP) siRNA
ttggctcatggcaaactctgcct

SEQ ID NO: 17316 - DNA, 23 bp, Artificial Sequence
  X-linked inhibitor of apoptosis (XIAP) siRNA
tggctcatggcaaactctgcctc

SEQ ID NO: 17317 - DNA, 23 bp, Artificial Sequence
  X-linked inhibitor of apoptosis (XIAP) siRNA
ggctcatggcaaactctgcctcg

SEQ ID NO: 17318 - DNA, 23 bp, Artificial Sequence
  X-linked inhibitor of apoptosis (XIAP) siRNA
gctcatggcaaactctgcctcgc

SEQ ID NO: 17319 - DNA, 23 bp, Artificial Sequence
  X-linked inhibitor of apoptosis (XIAP) siRNA
ctcatggcaaactctgcctcgca

SEQ ID NO: 17320 - DNA, 23 bp, Artificial Sequence
  X-linked inhibitor of apoptosis (XIAP) siRNA
tcatggcaaactctgcctcgcaa

SEQ ID NO: 17321 - DNA, 23 bp, Artificial Sequence
  X-linked inhibitor of apoptosis (XIAP) siRNA
catggcaaactctgcctcgcaag

SEQ ID NO: 17322 - DNA, 23 bp, Artificial Sequence
  X-linked inhibitor of apoptosis (XIAP) siRNA
atggcaaactctgcctcgcaagc

SEQ ID NO: 17323 - DNA, 23 bp, Artificial Sequence
  X-linked inhibitor of apoptosis (XIAP) siRNA
tggcaaactctgcctcgcaagca

SEQ ID NO: 17324 - DNA, 23 bp, Artificial Sequence
  X-linked inhibitor of apoptosis (XIAP) siRNA
ggcaaactctgcctcgcaagcag

SEQ ID NO: 17325 - DNA, 23 bp, Artificial Sequence
  X-linked inhibitor of apoptosis (XIAP) siRNA
gcaaactctgcctcgcaagcagc

SEQ ID NO: 17326 - DNA, 23 bp, Artificial Sequence
  X-linked inhibitor of apoptosis (XIAP) siRNA
caaactctgcctcgcaagcagct

SEQ ID NO: 17327 - DNA, 23 bp, Artificial Sequence
  X-linked inhibitor of apoptosis (XIAP) siRNA
aaactctgcctcgcaagcagctg

SEQ ID NO: 17328 - DNA, 23 bp, Artificial Sequence
  X-linked inhibitor of apoptosis (XIAP) siRNA
aactctgcctcgcaagcagctgg

SEQ ID NO: 17329 - DNA, 23 bp, Artificial Sequence
  X-linked inhibitor of apoptosis (XIAP) siRNA
actctgcctcgcaagcagctggg

SEQ ID NO: 17330 - DNA, 23 bp, Artificial Sequence
  X-linked inhibitor of apoptosis (XIAP) siRNA
ctctgcctcgcaagcagctggga

SEQ ID NO: 17331 - DNA, 23 bp, Artificial Sequence
  X-linked inhibitor of apoptosis (XIAP) siRNA
tctgcctcgcaagcagctgggac

SEQ ID NO: 17332 - DNA, 23 bp, Artificial Sequence
  X-linked inhibitor of apoptosis (XIAP) siRNA
ctgcctcgcaagcagctgggact

SEQ ID NO: 17333 - DNA, 23 bp, Artificial Sequence
  X-linked inhibitor of apoptosis (XIAP) siRNA
tgcctcgcaagcagctgggacta

SEQ ID NO: 17334 - DNA, 23 bp, Artificial Sequence
  X-linked inhibitor of apoptosis (XIAP) siRNA
gcctcgcaagcagctgggactac

SEQ ID NO: 17335 - DNA, 23 bp, Artificial Sequence
  X-linked inhibitor of apoptosis (XIAP) siRNA
cctcgcaagcagctgggactaca

SEQ ID NO: 17336 - DNA, 23 bp, Artificial Sequence
  X-linked inhibitor of apoptosis (XIAP) siRNA
ctcgcaagcagctgggactacag

SEQ ID NO: 17337 - DNA, 23 bp, Artificial Sequence
  X-linked inhibitor of apoptosis (XIAP) siRNA
tcgcaagcagctgggactacagg

SEQ ID NO: 17338 - DNA, 23 bp, Artificial Sequence
  X-linked inhibitor of apoptosis (XIAP) siRNA
cgcaagcagctgggactacaggc

SEQ ID NO: 17339 - DNA, 23 bp, Artificial Sequence
  X-linked inhibitor of apoptosis (XIAP) siRNA
gcaagcagctgggactacaggca

SEQ ID NO: 17340 - DNA, 23 bp, Artificial Sequence
  X-linked inhibitor of apoptosis (XIAP) siRNA
caagcagctgggactacaggcat

SEQ ID NO: 17341 - DNA, 23 bp, Artificial Sequence
  X-linked inhibitor of apoptosis (XIAP) siRNA
aagcagctgggactacaggcatg

SEQ ID NO: 17342 - DNA, 23 bp, Artificial Sequence
  X-linked inhibitor of apoptosis (XIAP) siRNA
agcagctgggactacaggcatgc

SEQ ID NO: 17343 - DNA, 23 bp, Artificial Sequence
  X-linked inhibitor of apoptosis (XIAP) siRNA
gcagctgggactacaggcatgct

SEQ ID NO: 17344 - DNA, 23 bp, Artificial Sequence
  X-linked inhibitor of apoptosis (XIAP) siRNA
cagctgggactacaggcatgctc

SEQ ID NO: 17345 - DNA, 23 bp, Artificial Sequence
  X-linked inhibitor of apoptosis (XIAP) siRNA
agctgggactacaggcatgctcc

SEQ ID NO: 17346 - DNA, 23 bp, Artificial Sequence
  X-linked inhibitor of apoptosis (XIAP) siRNA
gctgggactacaggcatgctcca

SEQ ID NO: 17347 - DNA, 23 bp, Artificial Sequence
  X-linked inhibitor of apoptosis (XIAP) siRNA
ctgggactacaggcatgctccac

SEQ ID NO: 17348 - DNA, 23 bp, Artificial Sequence
  X-linked inhibitor of apoptosis (XIAP) siRNA
tgggactacaggcatgctccacg

SEQ ID NO: 17349 - DNA, 23 bp, Artificial Sequence
  X-linked inhibitor of apoptosis (XIAP) siRNA
gggactacaggcatgctccacgg

SEQ ID NO: 17350 - DNA, 23 bp, Artificial Sequence
  X-linked inhibitor of apoptosis (XIAP) siRNA
ggactacaggcatgctccacggt

SEQ ID NO: 17351 - DNA, 23 bp, Artificial Sequence
  X-linked inhibitor of apoptosis (XIAP) siRNA
gactacaggcatgctccacggtg

SEQ ID NO: 17352 - DNA, 23 bp, Artificial Sequence
  X-linked inhibitor of apoptosis (XIAP) siRNA
actacaggcatgctccacggtgc

SEQ ID NO: 17353 - DNA, 23 bp, Artificial Sequence
  X-linked inhibitor of apoptosis (XIAP) siRNA
ctacaggcatgctccacggtgcc

SEQ ID NO: 17354 - DNA, 23 bp, Artificial Sequence
  X-linked inhibitor of apoptosis (XIAP) siRNA
tacaggcatgctccacggtgccc

SEQ ID NO: 17355 - DNA, 23 bp, Artificial Sequence
  X-linked inhibitor of apoptosis (XIAP) siRNA
acaggcatgctccacggtgccca

SEQ ID NO: 17356 - DNA, 23 bp, Artificial Sequence
  X-linked inhibitor of apoptosis (XIAP) siRNA
caggcatgctccacggtgcccag

SEQ ID NO: 17357 - DNA, 23 bp, Artificial Sequence
  X-linked inhibitor of apoptosis (XIAP) siRNA
aggcatgctccacggtgcccagt

SEQ ID NO: 17358 - DNA, 23 bp, Artificial Sequence
  X-linked inhibitor of apoptosis (XIAP) siRNA
ggcatgctccacggtgcccagtt

SEQ ID NO: 17359 - DNA, 23 bp, Artificial Sequence
  X-linked inhibitor of apoptosis (XIAP) siRNA
gcatgctccacggtgcccagtta

SEQ ID NO: 17360 - DNA, 23 bp, Artificial Sequence
  X-linked inhibitor of apoptosis (XIAP) siRNA
catgctccacggtgcccagttaa

SEQ ID NO: 17361 - DNA, 23 bp, Artificial Sequence
  X-linked inhibitor of apoptosis (XIAP) siRNA
atgctccacggtgcccagttaat

SEQ ID NO: 17362 - DNA, 23 bp, Artificial Sequence
  X-linked inhibitor of apoptosis (XIAP) siRNA
tgctccacggtgcccagttaatt

SEQ ID NO: 17363 - DNA, 23 bp, Artificial Sequence
  X-linked inhibitor of apoptosis (XIAP) siRNA
gctccacggtgcccagttaattt

SEQ ID NO: 17364 - DNA, 23 bp, Artificial Sequence
  X-linked inhibitor of apoptosis (XIAP) siRNA
ctccacggtgcccagttaatttt

SEQ ID NO: 17365 - DNA, 23 bp, Artificial Sequence
  X-linked inhibitor of apoptosis (XIAP) siRNA
tccacggtgcccagttaattttt

SEQ ID NO: 17366 - DNA, 23 bp, Artificial Sequence
  X-linked inhibitor of apoptosis (XIAP) siRNA
ccacggtgcccagttaatttttt

SEQ ID NO: 17367 - DNA, 23 bp, Artificial Sequence
  X-linked inhibitor of apoptosis (XIAP) siRNA
cacggtgcccagttaattttttt

SEQ ID NO: 17368 - DNA, 23 bp, Artificial Sequence
  X-linked inhibitor of apoptosis (XIAP) siRNA
acggtgcccagttaatttttttt

SEQ ID NO: 17369 - DNA, 23 bp, Artificial Sequence
  X-linked inhibitor of apoptosis (XIAP) siRNA
cggtgcccagttaattttttttg

SEQ ID NO: 17370 - DNA, 23 bp, Artificial Sequence
  X-linked inhibitor of apoptosis (XIAP) siRNA
ggtgcccagttaattttttttgt

SEQ ID NO: 17371 - DNA, 23 bp, Artificial Sequence
  X-linked inhibitor of apoptosis (XIAP) siRNA
gtgcccagttaattttttttgta

SEQ ID NO: 17372 - DNA, 23 bp, Artificial Sequence
  X-linked inhibitor of apoptosis (XIAP) siRNA
tgcccagttaattttttttgtat

SEQ ID NO: 17373 - DNA, 23 bp, Artificial Sequence
  X-linked inhibitor of apoptosis (XIAP) siRNA
gcccagttaattttttttgtatt

SEQ ID NO: 17374 - DNA, 23 bp, Artificial Sequence
  X-linked inhibitor of apoptosis (XIAP) siRNA
cccagttaattttttttgtattc

SEQ ID NO: 17375 - DNA, 23 bp, Artificial Sequence
  X-linked inhibitor of apoptosis (XIAP) siRNA
ccagttaattttttttgtattct

SEQ ID NO: 17376 - DNA, 23 bp, Artificial Sequence
  X-linked inhibitor of apoptosis (XIAP) siRNA
cagttaattttttttgtattctt

SEQ ID NO: 17377 - DNA, 23 bp, Artificial Sequence
  X-linked inhibitor of apoptosis (XIAP) siRNA
agttaattttttttgtattctta

SEQ ID NO: 17378 - DNA, 23 bp, Artificial Sequence
  X-linked inhibitor of apoptosis (XIAP) siRNA
gttaattttttttgtattcttag

SEQ ID NO: 17379 - DNA, 23 bp, Artificial Sequence
  X-linked inhibitor of apoptosis (XIAP) siRNA
ttaattttttttgtattcttagt

SEQ ID NO: 17380 - DNA, 23 bp, Artificial Sequence
  X-linked inhibitor of apoptosis (XIAP) siRNA
taattttttttgtattcttagta

SEQ ID NO: 17381 - DNA, 23 bp, Artificial Sequence
  X-linked inhibitor of apoptosis (XIAP) siRNA
aattttttttgtattcttagtag

SEQ ID NO: 17382 - DNA, 23 bp, Artificial Sequence
  X-linked inhibitor of apoptosis (XIAP) siRNA
attttttttgtattcttagtaga

SEQ ID NO: 17383 - DNA, 23 bp, Artificial Sequence
  X-linked inhibitor of apoptosis (XIAP) siRNA
ttttttttgtattcttagtagag

SEQ ID NO: 17384 - DNA, 23 bp, Artificial Sequence
  X-linked inhibitor of apoptosis (XIAP) siRNA
tttttttgtattcttagtagaga

SEQ ID NO: 17385 - DNA, 23 bp, Artificial Sequence
  X-linked inhibitor of apoptosis (XIAP) siRNA
ttttttgtattcttagtagagac

SEQ ID NO: 17386 - DNA, 23 bp, Artificial Sequence
  X-linked inhibitor of apoptosis (XIAP) siRNA
tttttgtattcttagtagagaca

SEQ ID NO: 17387 - DNA, 23 bp, Artificial Sequence
  X-linked inhibitor of apoptosis (XIAP) siRNA
ttttgtattcttagtagagacag

SEQ ID NO: 17388 - DNA, 23 bp, Artificial Sequence
  X-linked inhibitor of apoptosis (XIAP) siRNA
tttgtattcttagtagagacagg

SEQ ID NO: 17389 - DNA, 23 bp, Artificial Sequence
  X-linked inhibitor of apoptosis (XIAP) siRNA
ttgtattcttagtagagacaggg

SEQ ID NO: 17390 - DNA, 23 bp, Artificial Sequence
  X-linked inhibitor of apoptosis (XIAP) siRNA
tgtattcttagtagagacagggt

SEQ ID NO: 17391 - DNA, 23 bp, Artificial Sequence
  X-linked inhibitor of apoptosis (XIAP) siRNA
gtattcttagtagagacagggtt

SEQ ID NO: 17392 - DNA, 23 bp, Artificial Sequence
  X-linked inhibitor of apoptosis (XIAP) siRNA
tattcttagtagagacagggttt

SEQ ID NO: 17393 - DNA, 23 bp, Artificial Sequence
  X-linked inhibitor of apoptosis (XIAP) siRNA
attcttagtagagacagggtttc

SEQ ID NO: 17394 - DNA, 23 bp, Artificial Sequence
  X-linked inhibitor of apoptosis (XIAP) siRNA
ttcttagtagagacagggtttca

SEQ ID NO: 17395 - DNA, 23 bp, Artificial Sequence
  X-linked inhibitor of apoptosis (XIAP) siRNA
tcttagtagagacagggtttcac

SEQ ID NO: 17396 - DNA, 23 bp, Artificial Sequence
  X-linked inhibitor of apoptosis (XIAP) siRNA
cttagtagagacagggtttcacc

SEQ ID NO: 17397 - DNA, 23 bp, Artificial Sequence
  X-linked inhibitor of apoptosis (XIAP) siRNA
ttagtagagacagggtttcacca

SEQ ID NO: 17398 - DNA, 23 bp, Artificial Sequence
  X-linked inhibitor of apoptosis (XIAP) siRNA
tagtagagacagggtttcaccat

SEQ ID NO: 17399 - DNA, 23 bp, Artificial Sequence
  X-linked inhibitor of apoptosis (XIAP) siRNA
agtagagacagggtttcaccatg

SEQ ID NO: 17400 - DNA, 23 bp, Artificial Sequence
  X-linked inhibitor of apoptosis (XIAP) siRNA
gtagagacagggtttcaccatgt

SEQ ID NO: 17401 - DNA, 23 bp, Artificial Sequence
  X-linked inhibitor of apoptosis (XIAP) siRNA
tagagacagggtttcaccatgtt

SEQ ID NO: 17402 - DNA, 23 bp, Artificial Sequence
  X-linked inhibitor of apoptosis (XIAP) siRNA
agagacagggtttcaccatgttg

SEQ ID NO: 17403 - DNA, 23 bp, Artificial Sequence
  X-linked inhibitor of apoptosis (XIAP) siRNA
gagacagggtttcaccatgttgg

SEQ ID NO: 17404 - DNA, 23 bp, Artificial Sequence
  X-linked inhibitor of apoptosis (XIAP) siRNA
agacagggtttcaccatgttggc

SEQ ID NO: 17405 - DNA, 23 bp, Artificial Sequence
  X-linked inhibitor of apoptosis (XIAP) siRNA
gacagggtttcaccatgttggcc

SEQ ID NO: 17406 - DNA, 23 bp, Artificial Sequence
  X-linked inhibitor of apoptosis (XIAP) siRNA
acagggtttcaccatgttggcca

SEQ ID NO: 17407 - DNA, 23 bp, Artificial Sequence
  X-linked inhibitor of apoptosis (XIAP) siRNA
cagggtttcaccatgttggccag

SEQ ID NO: 17408 - DNA, 23 bp, Artificial Sequence
  X-linked inhibitor of apoptosis (XIAP) siRNA
agggtttcaccatgttggccagg

SEQ ID NO: 17409 - DNA, 23 bp, Artificial Sequence
  X-linked inhibitor of apoptosis (XIAP) siRNA
gggtttcaccatgttggccaggc

SEQ ID NO: 17410 - DNA, 23 bp, Artificial Sequence
  X-linked inhibitor of apoptosis (XIAP) siRNA
ggtttcaccatgttggccaggct

SEQ ID NO: 17411 - DNA, 23 bp, Artificial Sequence
  X-linked inhibitor of apoptosis (XIAP) siRNA
gtttcaccatgttggccaggcta

SEQ ID NO: 17412 - DNA, 23 bp, Artificial Sequence
  X-linked inhibitor of apoptosis (XIAP) siRNA
tttcaccatgttggccaggctag

SEQ ID NO: 17413 - DNA, 23 bp, Artificial Sequence
  X-linked inhibitor of apoptosis (XIAP) siRNA
ttcaccatgttggccaggctagt

SEQ ID NO: 17414 - DNA, 23 bp, Artificial Sequence
  X-linked inhibitor of apoptosis (XIAP) siRNA
tcaccatgttggccaggctagtc

SEQ ID NO: 17415 - DNA, 23 bp, Artificial Sequence
  X-linked inhibitor of apoptosis (XIAP) siRNA
caccatgttggccaggctagtct

SEQ ID NO: 17416 - DNA, 23 bp, Artificial Sequence
  X-linked inhibitor of apoptosis (XIAP) siRNA
accatgttggccaggctagtctt

SEQ ID NO: 17417 - DNA, 23 bp, Artificial Sequence
  X-linked inhibitor of apoptosis (XIAP) siRNA
ccatgttggccaggctagtcttg

SEQ ID NO: 17418 - DNA, 23 bp, Artificial Sequence
  X-linked inhibitor of apoptosis (XIAP) siRNA
catgttggccaggctagtcttga

SEQ ID NO: 17419 - DNA, 23 bp, Artificial Sequence
  X-linked inhibitor of apoptosis (XIAP) siRNA
atgttggccaggctagtcttgaa

SEQ ID NO: 17420 - DNA, 23 bp, Artificial Sequence
  X-linked inhibitor of apoptosis (XIAP) siRNA
tgttggccaggctagtcttgaat

SEQ ID NO: 17421 - DNA, 23 bp, Artificial Sequence
  X-linked inhibitor of apoptosis (XIAP) siRNA
gttggccaggctagtcttgaatt

SEQ ID NO: 17422 - DNA, 23 bp, Artificial Sequence
  X-linked inhibitor of apoptosis (XIAP) siRNA
ttggccaggctagtcttgaattt

SEQ ID NO: 17423 - DNA, 23 bp, Artificial Sequence
  X-linked inhibitor of apoptosis (XIAP) siRNA
tggccaggctagtcttgaatttc

SEQ ID NO: 17424 - DNA, 23 bp, Artificial Sequence
  X-linked inhibitor of apoptosis (XIAP) siRNA
ggccaggctagtcttgaatttct

SEQ ID NO: 17425 - DNA, 23 bp, Artificial Sequence
  X-linked inhibitor of apoptosis (XIAP) siRNA
gccaggctagtcttgaatttctg

SEQ ID NO: 17426 - DNA, 23 bp, Artificial Sequence
  X-linked inhibitor of apoptosis (XIAP) siRNA
ccaggctagtcttgaatttctga

SEQ ID NO: 17427 - DNA, 23 bp, Artificial Sequence
  X-linked inhibitor of apoptosis (XIAP) siRNA
caggctagtcttgaatttctgac

SEQ ID NO: 17428 - DNA, 23 bp, Artificial Sequence
  X-linked inhibitor of apoptosis (XIAP) siRNA
aggctagtcttgaatttctgacc

SEQ ID NO: 17429 - DNA, 23 bp, Artificial Sequence
  X-linked inhibitor of apoptosis (XIAP) siRNA
ggctagtcttgaatttctgacct

SEQ ID NO: 17430 - DNA, 23 bp, Artificial Sequence
  X-linked inhibitor of apoptosis (XIAP) siRNA
gctagtcttgaatttctgacctc

SEQ ID NO: 17431 - DNA, 23 bp, Artificial Sequence
  X-linked inhibitor of apoptosis (XIAP) siRNA
ctagtcttgaatttctgacctca

SEQ ID NO: 17432 - DNA, 23 bp, Artificial Sequence
  X-linked inhibitor of apoptosis (XIAP) siRNA
tagtcttgaatttctgacctcaa

SEQ ID NO: 17433 - DNA, 23 bp, Artificial Sequence
  X-linked inhibitor of apoptosis (XIAP) siRNA
agtcttgaatttctgacctcaag

SEQ ID NO: 17434 - DNA, 23 bp, Artificial Sequence
  X-linked inhibitor of apoptosis (XIAP) siRNA
gtcttgaatttctgacctcaagt

SEQ ID NO: 17435 - DNA, 23 bp, Artificial Sequence
  X-linked inhibitor of apoptosis (XIAP) siRNA
tcttgaatttctgacctcaagtg

SEQ ID NO: 17436 - DNA, 23 bp, Artificial Sequence
  X-linked inhibitor of apoptosis (XIAP) siRNA
cttgaatttctgacctcaagtga

SEQ ID NO: 17437 - DNA, 23 bp, Artificial Sequence
  X-linked inhibitor of apoptosis (XIAP) siRNA
ttgaatttctgacctcaagtgat

SEQ ID NO: 17438 - DNA, 23 bp, Artificial Sequence
  X-linked inhibitor of apoptosis (XIAP) siRNA
tgaatttctgacctcaagtgatt

SEQ ID NO: 17439 - DNA, 23 bp, Artificial Sequence
  X-linked inhibitor of apoptosis (XIAP) siRNA
gaatttctgacctcaagtgattc

SEQ ID NO: 17440 - DNA, 23 bp, Artificial Sequence
  X-linked inhibitor of apoptosis (XIAP) siRNA
aatttctgacctcaagtgattca

SEQ ID NO: 17441 - DNA, 23 bp, Artificial Sequence
  X-linked inhibitor of apoptosis (XIAP) siRNA
atttctgacctcaagtgattcat

SEQ ID NO: 17442 - DNA, 23 bp, Artificial Sequence
  X-linked inhibitor of apoptosis (XIAP) siRNA
tttctgacctcaagtgattcatc

SEQ ID NO: 17443 - DNA, 23 bp, Artificial Sequence
  X-linked inhibitor of apoptosis (XIAP) siRNA
ttctgacctcaagtgattcatct

SEQ ID NO: 17444 - DNA, 23 bp, Artificial Sequence
  X-linked inhibitor of apoptosis (XIAP) siRNA
tctgacctcaagtgattcatctc

SEQ ID NO: 17445 - DNA, 23 bp, Artificial Sequence
  X-linked inhibitor of apoptosis (XIAP) siRNA
ctgacctcaagtgattcatctcc

SEQ ID NO: 17446 - DNA, 23 bp, Artificial Sequence
  X-linked inhibitor of apoptosis (XIAP) siRNA
tgacctcaagtgattcatctccc

SEQ ID NO: 17447 - DNA, 23 bp, Artificial Sequence
  X-linked inhibitor of apoptosis (XIAP) siRNA
gacctcaagtgattcatctccca

SEQ ID NO: 17448 - DNA, 23 bp, Artificial Sequence
  X-linked inhibitor of apoptosis (XIAP) siRNA
acctcaagtgattcatctcccaa

SEQ ID NO: 17449 - DNA, 23 bp, Artificial Sequence
  X-linked inhibitor of apoptosis (XIAP) siRNA
cctcaagtgattcatctcccaaa

SEQ ID NO: 17450 - DNA, 23 bp, Artificial Sequence
  X-linked inhibitor of apoptosis (XIAP) siRNA
ctcaagtgattcatctcccaaag

SEQ ID NO: 17451 - DNA, 23 bp, Artificial Sequence
  X-linked inhibitor of apoptosis (XIAP) siRNA
tcaagtgattcatctcccaaagt

SEQ ID NO: 17452 - DNA, 23 bp, Artificial Sequence
  X-linked inhibitor of apoptosis (XIAP) siRNA
caagtgattcatctcccaaagtg

SEQ ID NO: 17453 - DNA, 23 bp, Artificial Sequence
  X-linked inhibitor of apoptosis (XIAP) siRNA
aagtgattcatctcccaaagtgc

SEQ ID NO: 17454 - DNA, 23 bp, Artificial Sequence
  X-linked inhibitor of apoptosis (XIAP) siRNA
agtgattcatctcccaaagtgct

SEQ ID NO: 17455 - DNA, 23 bp, Artificial Sequence
  X-linked inhibitor of apoptosis (XIAP) siRNA
gtgattcatctcccaaagtgctg

SEQ ID NO: 17456 - DNA, 23 bp, Artificial Sequence
  X-linked inhibitor of apoptosis (XIAP) siRNA
tgattcatctcccaaagtgctgg

SEQ ID NO: 17457 - DNA, 23 bp, Artificial Sequence
  X-linked inhibitor of apoptosis (XIAP) siRNA
gattcatctcccaaagtgctggg

SEQ ID NO: 17458 - DNA, 23 bp, Artificial Sequence
  X-linked inhibitor of apoptosis (XIAP) siRNA
attcatctcccaaagtgctggga

SEQ ID NO: 17459 - DNA, 23 bp, Artificial Sequence
  X-linked inhibitor of apoptosis (XIAP) siRNA
ttcatctcccaaagtgctgggat

SEQ ID NO: 17460 - DNA, 23 bp, Artificial Sequence
  X-linked inhibitor of apoptosis (XIAP) siRNA
tcatctcccaaagtgctgggatt

SEQ ID NO: 17461 - DNA, 23 bp, Artificial Sequence
  X-linked inhibitor of apoptosis (XIAP) siRNA
catctcccaaagtgctgggatta

SEQ ID NO: 17462 - DNA, 23 bp, Artificial Sequence
  X-linked inhibitor of apoptosis (XIAP) siRNA
atctcccaaagtgctgggattac

SEQ ID NO: 17463 - DNA, 23 bp, Artificial Sequence
  X-linked inhibitor of apoptosis (XIAP) siRNA
tctcccaaagtgctgggattaca

SEQ ID NO: 17464 - DNA, 23 bp, Artificial Sequence
  X-linked inhibitor of apoptosis (XIAP) siRNA
ctcccaaagtgctgggattacag

SEQ ID NO: 17465 - DNA, 23 bp, Artificial Sequence
  X-linked inhibitor of apoptosis (XIAP) siRNA
tcccaaagtgctgggattacagg

SEQ ID NO: 17466 - DNA, 23 bp, Artificial Sequence
  X-linked inhibitor of apoptosis (XIAP) siRNA
cccaaagtgctgggattacaggc

SEQ ID NO: 17467 - DNA, 23 bp, Artificial Sequence
  X-linked inhibitor of apoptosis (XIAP) siRNA
ccaaagtgctgggattacaggcg

SEQ ID NO: 17468 - DNA, 23 bp, Artificial Sequence
  X-linked inhibitor of apoptosis (XIAP) siRNA
caaagtgctgggattacaggcgt

SEQ ID NO: 17469 - DNA, 23 bp, Artificial Sequence
  X-linked inhibitor of apoptosis (XIAP) siRNA
aaagtgctgggattacaggcgtg

SEQ ID NO: 17470 - DNA, 23 bp, Artificial Sequence
  X-linked inhibitor of apoptosis (XIAP) siRNA
aagtgctgggattacaggcgtga

SEQ ID NO: 17471 - DNA, 23 bp, Artificial Sequence
  X-linked inhibitor of apoptosis (XIAP) siRNA
agtgctgggattacaggcgtgag

SEQ ID NO: 17472 - DNA, 23 bp, Artificial Sequence
  X-linked inhibitor of apoptosis (XIAP) siRNA
gtgctgggattacaggcgtgagc

SEQ ID NO: 17473 - DNA, 23 bp, Artificial Sequence
  X-linked inhibitor of apoptosis (XIAP) siRNA
tgctgggattacaggcgtgagcc

SEQ ID NO: 17474 - DNA, 23 bp, Artificial Sequence
  X-linked inhibitor of apoptosis (XIAP) siRNA
gctgggattacaggcgtgagcca

SEQ ID NO: 17475 - DNA, 23 bp, Artificial Sequence
  X-linked inhibitor of apoptosis (XIAP) siRNA
ctgggattacaggcgtgagccac

SEQ ID NO: 17476 - DNA, 23 bp, Artificial Sequence
  X-linked inhibitor of apoptosis (XIAP) siRNA
tgggattacaggcgtgagccacc

SEQ ID NO: 17477 - DNA, 23 bp, Artificial Sequence
  X-linked inhibitor of apoptosis (XIAP) siRNA
gggattacaggcgtgagccacca

SEQ ID NO: 17478 - DNA, 23 bp, Artificial Sequence
  X-linked inhibitor of apoptosis (XIAP) siRNA
ggattacaggcgtgagccaccac

SEQ ID NO: 17479 - DNA, 23 bp, Artificial Sequence
  X-linked inhibitor of apoptosis (XIAP) siRNA
gattacaggcgtgagccaccacg

SEQ ID NO: 17480 - DNA, 23 bp, Artificial Sequence
  X-linked inhibitor of apoptosis (XIAP) siRNA
attacaggcgtgagccaccacgg

SEQ ID NO: 17481 - DNA, 23 bp, Artificial Sequence
  X-linked inhibitor of apoptosis (XIAP) siRNA
ttacaggcgtgagccaccacggc

SEQ ID NO: 17482 - DNA, 23 bp, Artificial Sequence
  X-linked inhibitor of apoptosis (XIAP) siRNA
tacaggcgtgagccaccacggcc

SEQ ID NO: 17483 - DNA, 23 bp, Artificial Sequence
  X-linked inhibitor of apoptosis (XIAP) siRNA
acaggcgtgagccaccacggccg

SEQ ID NO: 17484 - DNA, 23 bp, Artificial Sequence
  X-linked inhibitor of apoptosis (XIAP) siRNA
caggcgtgagccaccacggccgg

SEQ ID NO: 17485 - DNA, 23 bp, Artificial Sequence
  X-linked inhibitor of apoptosis (XIAP) siRNA
aggcgtgagccaccacggccggc

SEQ ID NO: 17486 - DNA, 23 bp, Artificial Sequence
  X-linked inhibitor of apoptosis (XIAP) siRNA
ggcgtgagccaccacggccggct

SEQ ID NO: 17487 - DNA, 23 bp, Artificial Sequence
  X-linked inhibitor of apoptosis (XIAP) siRNA
gcgtgagccaccacggccggcta

SEQ ID NO: 17488 - DNA, 23 bp, Artificial Sequence
  X-linked inhibitor of apoptosis (XIAP) siRNA
cgtgagccaccacggccggctaa

SEQ ID NO: 17489 - DNA, 23 bp, Artificial Sequence
  X-linked inhibitor of apoptosis (XIAP) siRNA
gtgagccaccacggccggctaat

SEQ ID NO: 17490 - DNA, 23 bp, Artificial Sequence
  X-linked inhibitor of apoptosis (XIAP) siRNA
tgagccaccacggccggctaatt

SEQ ID NO: 17491 - DNA, 23 bp, Artificial Sequence
  X-linked inhibitor of apoptosis (XIAP) siRNA
gagccaccacggccggctaattt

SEQ ID NO: 17492 - DNA, 23 bp, Artificial Sequence
  X-linked inhibitor of apoptosis (XIAP) siRNA
agccaccacggccggctaatttt

SEQ ID NO: 17493 - DNA, 23 bp, Artificial Sequence
  X-linked inhibitor of apoptosis (XIAP) siRNA
gccaccacggccggctaattttt

SEQ ID NO: 17494 - DNA, 23 bp, Artificial Sequence
  X-linked inhibitor of apoptosis (XIAP) siRNA
ccaccacggccggctaatttttg

SEQ ID NO: 17495 - DNA, 23 bp, Artificial Sequence
  X-linked inhibitor of apoptosis (XIAP) siRNA
caccacggccggctaatttttgt

SEQ ID NO: 17496 - DNA, 23 bp, Artificial Sequence
  X-linked inhibitor of apoptosis (XIAP) siRNA
accacggccggctaatttttgta

SEQ ID NO: 17497 - DNA, 23 bp, Artificial Sequence
  X-linked inhibitor of apoptosis (XIAP) siRNA
ccacggccggctaatttttgtat

SEQ ID NO: 17498 - DNA, 23 bp, Artificial Sequence
  X-linked inhibitor of apoptosis (XIAP) siRNA
cacggccggctaatttttgtatt

SEQ ID NO: 17499 - DNA, 23 bp, Artificial Sequence
  X-linked inhibitor of apoptosis (XIAP) siRNA
acggccggctaatttttgtattt

SEQ ID NO: 17500 - DNA, 23 bp, Artificial Sequence
  X-linked inhibitor of apoptosis (XIAP) siRNA
cggccggctaatttttgtatttt

SEQ ID NO: 17501 - DNA, 23 bp, Artificial Sequence
  X-linked inhibitor of apoptosis (XIAP) siRNA
ggccggctaatttttgtattttt

SEQ ID NO: 17502 - DNA, 23 bp, Artificial Sequence
  X-linked inhibitor of apoptosis (XIAP) siRNA
gccggctaatttttgtatttttt

SEQ ID NO: 17503 - DNA, 23 bp, Artificial Sequence
  X-linked inhibitor of apoptosis (XIAP) siRNA
ccggctaatttttgtatttttta

SEQ ID NO: 17504 - DNA, 23 bp, Artificial Sequence
  X-linked inhibitor of apoptosis (XIAP) siRNA
cggctaatttttgtattttttag

SEQ ID NO: 17505 - DNA, 23 bp, Artificial Sequence
  X-linked inhibitor of apoptosis (XIAP) siRNA
ggctaatttttgtattttttagt

SEQ ID NO: 17506 - DNA, 23 bp, Artificial Sequence
  X-linked inhibitor of apoptosis (XIAP) siRNA
gctaatttttgtattttttagta

SEQ ID NO: 17507 - DNA, 23 bp, Artificial Sequence
  X-linked inhibitor of apoptosis (XIAP) siRNA
ctaatttttgtattttttagtag

SEQ ID NO: 17508 - DNA, 23 bp, Artificial Sequence
  X-linked inhibitor of apoptosis (XIAP) siRNA
taatttttgtattttttagtagt

SEQ ID NO: 17509 - DNA, 23 bp, Artificial Sequence
  X-linked inhibitor of apoptosis (XIAP) siRNA
aatttttgtattttttagtagtg

SEQ ID NO: 17510 - DNA, 23 bp, Artificial Sequence
  X-linked inhibitor of apoptosis (XIAP) siRNA
atttttgtattttttagtagtga

SEQ ID NO: 17511 - DNA, 23 bp, Artificial Sequence
  X-linked inhibitor of apoptosis (XIAP) siRNA
tttttgtattttttagtagtgac

SEQ ID NO: 17512 - DNA, 23 bp, Artificial Sequence
  X-linked inhibitor of apoptosis (XIAP) siRNA
ttttgtattttttagtagtgact

SEQ ID NO: 17513 - DNA, 23 bp, Artificial Sequence
  X-linked inhibitor of apoptosis (XIAP) siRNA
tttgtattttttagtagtgactg

SEQ ID NO: 17514 - DNA, 23 bp, Artificial Sequence
  X-linked inhibitor of apoptosis (XIAP) siRNA
ttgtattttttagtagtgactgg

SEQ ID NO: 17515 - DNA, 23 bp, Artificial Sequence
  X-linked inhibitor of apoptosis (XIAP) siRNA
tgtattttttagtagtgactggt

SEQ ID NO: 17516 - DNA, 23 bp, Artificial Sequence
  X-linked inhibitor of apoptosis (XIAP) siRNA
gtattttttagtagtgactggtt

SEQ ID NO: 17517 - DNA, 23 bp, Artificial Sequence
  X-linked inhibitor of apoptosis (XIAP) siRNA
tattttttagtagtgactggttt

SEQ ID NO: 17518 - DNA, 23 bp, Artificial Sequence
  X-linked inhibitor of apoptosis (XIAP) siRNA
attttttagtagtgactggtttc

SEQ ID NO: 17519 - DNA, 23 bp, Artificial Sequence
  X-linked inhibitor of apoptosis (XIAP) siRNA
ttttttagtagtgactggtttcg

SEQ ID NO: 17520 - DNA, 23 bp, Artificial Sequence
  X-linked inhibitor of apoptosis (XIAP) siRNA
tttttagtagtgactggtttcgc

SEQ ID NO: 17521 - DNA, 23 bp, Artificial Sequence
  X-linked inhibitor of apoptosis (XIAP) siRNA
ttttagtagtgactggtttcgcg

SEQ ID NO: 17522 - DNA, 23 bp, Artificial Sequence
  X-linked inhibitor of apoptosis (XIAP) siRNA
tttagtagtgactggtttcgcgg

SEQ ID NO: 17523 - DNA, 23 bp, Artificial Sequence
  X-linked inhibitor of apoptosis (XIAP) siRNA
ttagtagtgactggtttcgcggt

SEQ ID NO: 17524 - DNA, 23 bp, Artificial Sequence
  X-linked inhibitor of apoptosis (XIAP) siRNA
tagtagtgactggtttcgcggtg

SEQ ID NO: 17525 - DNA, 23 bp, Artificial Sequence
  X-linked inhibitor of apoptosis (XIAP) siRNA
agtagtgactggtttcgcggtgt

SEQ ID NO: 17526 - DNA, 23 bp, Artificial Sequence
  X-linked inhibitor of apoptosis (XIAP) siRNA
gtagtgactggtttcgcggtgtt

SEQ ID NO: 17527 - DNA, 23 bp, Artificial Sequence
  X-linked inhibitor of apoptosis (XIAP) siRNA
tagtgactggtttcgcggtgttg

SEQ ID NO: 17528 - DNA, 23 bp, Artificial Sequence
  X-linked inhibitor of apoptosis (XIAP) siRNA
agtgactggtttcgcggtgttga

SEQ ID NO: 17529 - DNA, 23 bp, Artificial Sequence
  X-linked inhibitor of apoptosis (XIAP) siRNA
gtgactggtttcgcggtgttgac

SEQ ID NO: 17530 - DNA, 23 bp, Artificial Sequence
  X-linked inhibitor of apoptosis (XIAP) siRNA
tgactggtttcgcggtgttgacc

SEQ ID NO: 17531 - DNA, 23 bp, Artificial Sequence
  X-linked inhibitor of apoptosis (XIAP) siRNA
gactggtttcgcggtgttgacca

SEQ ID NO: 17532 - DNA, 23 bp, Artificial Sequence
  X-linked inhibitor of apoptosis (XIAP) siRNA
actggtttcgcggtgttgaccag

SEQ ID NO: 17533 - DNA, 23 bp, Artificial Sequence
  X-linked inhibitor of apoptosis (XIAP) siRNA
ctggtttcgcggtgttgaccagg

SEQ ID NO: 17534 - DNA, 23 bp, Artificial Sequence
  X-linked inhibitor of apoptosis (XIAP) siRNA
tggtttcgcggtgttgaccaggc

SEQ ID NO: 17535 - DNA, 23 bp, Artificial Sequence
  X-linked inhibitor of apoptosis (XIAP) siRNA
ggtttcgcggtgttgaccaggct

SEQ ID NO: 17536 - DNA, 23 bp, Artificial Sequence
  X-linked inhibitor of apoptosis (XIAP) siRNA
gtttcgcggtgttgaccaggctg

SEQ ID NO: 17537 - DNA, 23 bp, Artificial Sequence
  X-linked inhibitor of apoptosis (XIAP) siRNA
tttcgcggtgttgaccaggctgg

SEQ ID NO: 17538 - DNA, 23 bp, Artificial Sequence
  X-linked inhibitor of apoptosis (XIAP) siRNA
ttcgcggtgttgaccaggctggt

SEQ ID NO: 17539 - DNA, 23 bp, Artificial Sequence
  X-linked inhibitor of apoptosis (XIAP) siRNA
tcgcggtgttgaccaggctggtc

SEQ ID NO: 17540 - DNA, 23 bp, Artificial Sequence
  X-linked inhibitor of apoptosis (XIAP) siRNA
cgcggtgttgaccaggctggtct

SEQ ID NO: 17541 - DNA, 23 bp, Artificial Sequence
  X-linked inhibitor of apoptosis (XIAP) siRNA
gcggtgttgaccaggctggtctc

SEQ ID NO: 17542 - DNA, 23 bp, Artificial Sequence
  X-linked inhibitor of apoptosis (XIAP) siRNA
cggtgttgaccaggctggtctcg

SEQ ID NO: 17543 - DNA, 23 bp, Artificial Sequence
  X-linked inhibitor of apoptosis (XIAP) siRNA
ggtgttgaccaggctggtctcga

SEQ ID NO: 17544 - DNA, 23 bp, Artificial Sequence
  X-linked inhibitor of apoptosis (XIAP) siRNA
gtgttgaccaggctggtctcgaa

SEQ ID NO: 17545 - DNA, 23 bp, Artificial Sequence
  X-linked inhibitor of apoptosis (XIAP) siRNA
tgttgaccaggctggtctcgaac

SEQ ID NO: 17546 - DNA, 23 bp, Artificial Sequence
  X-linked inhibitor of apoptosis (XIAP) siRNA
gttgaccaggctggtctcgaact

SEQ ID NO: 17547 - DNA, 23 bp, Artificial Sequence
  X-linked inhibitor of apoptosis (XIAP) siRNA
ttgaccaggctggtctcgaactc

SEQ ID NO: 17548 - DNA, 23 bp, Artificial Sequence
  X-linked inhibitor of apoptosis (XIAP) siRNA
tgaccaggctggtctcgaactcc

SEQ ID NO: 17549 - DNA, 23 bp, Artificial Sequence
  X-linked inhibitor of apoptosis (XIAP) siRNA
gaccaggctggtctcgaactcct

SEQ ID NO: 17550 - DNA, 23 bp, Artificial Sequence
  X-linked inhibitor of apoptosis (XIAP) siRNA
accaggctggtctcgaactcctg

SEQ ID NO: 17551 - DNA, 23 bp, Artificial Sequence
  X-linked inhibitor of apoptosis (XIAP) siRNA
ccaggctggtctcgaactcctga

SEQ ID NO: 17552 - DNA, 23 bp, Artificial Sequence
  X-linked inhibitor of apoptosis (XIAP) siRNA
caggctggtctcgaactcctgat

SEQ ID NO: 17553 - DNA, 23 bp, Artificial Sequence
  X-linked inhibitor of apoptosis (XIAP) siRNA
aggctggtctcgaactcctgatc

SEQ ID NO: 17554 - DNA, 23 bp, Artificial Sequence
  X-linked inhibitor of apoptosis (XIAP) siRNA
ggctggtctcgaactcctgatct

SEQ ID NO: 17555 - DNA, 23 bp, Artificial Sequence
  X-linked inhibitor of apoptosis (XIAP) siRNA
gctggtctcgaactcctgatctc

SEQ ID NO: 17556 - DNA, 23 bp, Artificial Sequence
  X-linked inhibitor of apoptosis (XIAP) siRNA
ctggtctcgaactcctgatctca

SEQ ID NO: 17557 - DNA, 23 bp, Artificial Sequence
  X-linked inhibitor of apoptosis (XIAP) siRNA
tggtctcgaactcctgatctcag

SEQ ID NO: 17558 - DNA, 23 bp, Artificial Sequence
  X-linked inhibitor of apoptosis (XIAP) siRNA
ggtctcgaactcctgatctcagg

SEQ ID NO: 17559 - DNA, 23 bp, Artificial Sequence
  X-linked inhibitor of apoptosis (XIAP) siRNA
gtctcgaactcctgatctcaggt

SEQ ID NO: 17560 - DNA, 23 bp, Artificial Sequence
  X-linked inhibitor of apoptosis (XIAP) siRNA
tctcgaactcctgatctcaggtg

SEQ ID NO: 17561 - DNA, 23 bp, Artificial Sequence
  X-linked inhibitor of apoptosis (XIAP) siRNA
ctcgaactcctgatctcaggtga

SEQ ID NO: 17562 - DNA, 23 bp, Artificial Sequence
  X-linked inhibitor of apoptosis (XIAP) siRNA
tcgaactcctgatctcaggtgat

SEQ ID NO: 17563 - DNA, 23 bp, Artificial Sequence
  X-linked inhibitor of apoptosis (XIAP) siRNA
cgaactcctgatctcaggtgatc

SEQ ID NO: 17564 - DNA, 23 bp, Artificial Sequence
  X-linked inhibitor of apoptosis (XIAP) siRNA
gaactcctgatctcaggtgatct

SEQ ID NO: 17565 - DNA, 23 bp, Artificial Sequence
  X-linked inhibitor of apoptosis (XIAP) siRNA
aactcctgatctcaggtgatctg

SEQ ID NO: 17566 - DNA, 23 bp, Artificial Sequence
  X-linked inhibitor of apoptosis (XIAP) siRNA
actcctgatctcaggtgatctgc

SEQ ID NO: 17567 - DNA, 23 bp, Artificial Sequence
  X-linked inhibitor of apoptosis (XIAP) siRNA
ctcctgatctcaggtgatctgcc

SEQ ID NO: 17568 - DNA, 23 bp, Artificial Sequence
  X-linked inhibitor of apoptosis (XIAP) siRNA
tcctgatctcaggtgatctgcct

SEQ ID NO: 17569 - DNA, 23 bp, Artificial Sequence
  X-linked inhibitor of apoptosis (XIAP) siRNA
cctgatctcaggtgatctgcctg

SEQ ID NO: 17570 - DNA, 23 bp, Artificial Sequence
  X-linked inhibitor of apoptosis (XIAP) siRNA
ctgatctcaggtgatctgcctgc

SEQ ID NO: 17571 - DNA, 23 bp, Artificial Sequence
  X-linked inhibitor of apoptosis (XIAP) siRNA
tgatctcaggtgatctgcctgcc

SEQ ID NO: 17572 - DNA, 23 bp, Artificial Sequence
  X-linked inhibitor of apoptosis (XIAP) siRNA
gatctcaggtgatctgcctgcct

SEQ ID NO: 17573 - DNA, 23 bp, Artificial Sequence
  X-linked inhibitor of apoptosis (XIAP) siRNA
atctcaggtgatctgcctgcctc

SEQ ID NO: 17574 - DNA, 23 bp, Artificial Sequence
  X-linked inhibitor of apoptosis (XIAP) siRNA
tctcaggtgatctgcctgcctcg

SEQ ID NO: 17575 - DNA, 23 bp, Artificial Sequence
  X-linked inhibitor of apoptosis (XIAP) siRNA
ctcaggtgatctgcctgcctcgg

SEQ ID NO: 17576 - DNA, 23 bp, Artificial Sequence
  X-linked inhibitor of apoptosis (XIAP) siRNA
tcaggtgatctgcctgcctcggc

SEQ ID NO: 17577 - DNA, 23 bp, Artificial Sequence
  X-linked inhibitor of apoptosis (XIAP) siRNA
caggtgatctgcctgcctcggcc

SEQ ID NO: 17578 - DNA, 23 bp, Artificial Sequence
  X-linked inhibitor of apoptosis (XIAP) siRNA
aggtgatctgcctgcctcggcct

SEQ ID NO: 17579 - DNA, 23 bp, Artificial Sequence
  X-linked inhibitor of apoptosis (XIAP) siRNA
ggtgatctgcctgcctcggcctc

SEQ ID NO: 17580 - DNA, 23 bp, Artificial Sequence
  X-linked inhibitor of apoptosis (XIAP) siRNA
gtgatctgcctgcctcggcctca

SEQ ID NO: 17581 - DNA, 23 bp, Artificial Sequence
  X-linked inhibitor of apoptosis (XIAP) siRNA
tgatctgcctgcctcggcctcac

SEQ ID NO: 17582 - DNA, 23 bp, Artificial Sequence
  X-linked inhibitor of apoptosis (XIAP) siRNA
gatctgcctgcctcggcctcaca

SEQ ID NO: 17583 - DNA, 23 bp, Artificial Sequence
  X-linked inhibitor of apoptosis (XIAP) siRNA
atctgcctgcctcggcctcacaa

SEQ ID NO: 17584 - DNA, 23 bp, Artificial Sequence
  X-linked inhibitor of apoptosis (XIAP) siRNA
tctgcctgcctcggcctcacaaa

SEQ ID NO: 17585 - DNA, 23 bp, Artificial Sequence
  X-linked inhibitor of apoptosis (XIAP) siRNA
ctgcctgcctcggcctcacaaag

SEQ ID NO: 17586 - DNA, 23 bp, Artificial Sequence
  X-linked inhibitor of apoptosis (XIAP) siRNA
tgcctgcctcggcctcacaaagt

SEQ ID NO: 17587 - DNA, 23 bp, Artificial Sequence
  X-linked inhibitor of apoptosis (XIAP) siRNA
gcctgcctcggcctcacaaagtg

SEQ ID NO: 17588 - DNA, 23 bp, Artificial Sequence
  X-linked inhibitor of apoptosis (XIAP) siRNA
cctgcctcggcctcacaaagtgc

SEQ ID NO: 17589 - DNA, 23 bp, Artificial Sequence
  X-linked inhibitor of apoptosis (XIAP) siRNA
ctgcctcggcctcacaaagtgct

SEQ ID NO: 17590 - DNA, 23 bp, Artificial Sequence
  X-linked inhibitor of apoptosis (XIAP) siRNA
tgcctcggcctcacaaagtgctg

SEQ ID NO: 17591 - DNA, 23 bp, Artificial Sequence
  X-linked inhibitor of apoptosis (XIAP) siRNA
gcctcggcctcacaaagtgctgg

SEQ ID NO: 17592 - DNA, 23 bp, Artificial Sequence
  X-linked inhibitor of apoptosis (XIAP) siRNA
cctcggcctcacaaagtgctggg

SEQ ID NO: 17593 - DNA, 23 bp, Artificial Sequence
  X-linked inhibitor of apoptosis (XIAP) siRNA
ctcggcctcacaaagtgctggga

SEQ ID NO: 17594 - DNA, 23 bp, Artificial Sequence
  X-linked inhibitor of apoptosis (XIAP) siRNA
tcggcctcacaaagtgctgggat

SEQ ID NO: 17595 - DNA, 23 bp, Artificial Sequence
  X-linked inhibitor of apoptosis (XIAP) siRNA
cggcctcacaaagtgctgggatt

SEQ ID NO: 17596 - DNA, 23 bp, Artificial Sequence
  X-linked inhibitor of apoptosis (XIAP) siRNA
ggcctcacaaagtgctgggatta

SEQ ID NO: 17597 - DNA, 23 bp, Artificial Sequence
  X-linked inhibitor of apoptosis (XIAP) siRNA
gcctcacaaagtgctgggattac

SEQ ID NO: 17598 - DNA, 23 bp, Artificial Sequence
  X-linked inhibitor of apoptosis (XIAP) siRNA
cctcacaaagtgctgggattaca

SEQ ID NO: 17599 - DNA, 23 bp, Artificial Sequence
  X-linked inhibitor of apoptosis (XIAP) siRNA
ctcacaaagtgctgggattacag

SEQ ID NO: 17600 - DNA, 23 bp, Artificial Sequence
  X-linked inhibitor of apoptosis (XIAP) siRNA
tcacaaagtgctgggattacagg

SEQ ID NO: 17601 - DNA, 23 bp, Artificial Sequence
  X-linked inhibitor of apoptosis (XIAP) siRNA
cacaaagtgctgggattacaggt

SEQ ID NO: 17602 - DNA, 23 bp, Artificial Sequence
  X-linked inhibitor of apoptosis (XIAP) siRNA
acaaagtgctgggattacaggtg

SEQ ID NO: 17603 - DNA, 23 bp, Artificial Sequence
  X-linked inhibitor of apoptosis (XIAP) siRNA
caaagtgctgggattacaggtgt

SEQ ID NO: 17604 - DNA, 23 bp, Artificial Sequence
  X-linked inhibitor of apoptosis (XIAP) siRNA
aaagtgctgggattacaggtgtg

SEQ ID NO: 17605 - DNA, 23 bp, Artificial Sequence
  X-linked inhibitor of apoptosis (XIAP) siRNA
aagtgctgggattacaggtgtga

SEQ ID NO: 17606 - DNA, 23 bp, Artificial Sequence
  X-linked inhibitor of apoptosis (XIAP) siRNA
agtgctgggattacaggtgtgaa

SEQ ID NO: 17607 - DNA, 23 bp, Artificial Sequence
  X-linked inhibitor of apoptosis (XIAP) siRNA
gtgctgggattacaggtgtgaac

SEQ ID NO: 17608 - DNA, 23 bp, Artificial Sequence
  X-linked inhibitor of apoptosis (XIAP) siRNA
tgctgggattacaggtgtgaacc

SEQ ID NO: 17609 - DNA, 23 bp, Artificial Sequence
  X-linked inhibitor of apoptosis (XIAP) siRNA
gctgggattacaggtgtgaacca

SEQ ID NO: 17610 - DNA, 23 bp, Artificial Sequence
  X-linked inhibitor of apoptosis (XIAP) siRNA
ctgggattacaggtgtgaaccac

SEQ ID NO: 17611 - DNA, 23 bp, Artificial Sequence
  X-linked inhibitor of apoptosis (XIAP) siRNA
tgggattacaggtgtgaaccact

SEQ ID NO: 17612 - DNA, 23 bp, Artificial Sequence
  X-linked inhibitor of apoptosis (XIAP) siRNA
gggattacaggtgtgaaccactg

SEQ ID NO: 17613 - DNA, 23 bp, Artificial Sequence
  X-linked inhibitor of apoptosis (XIAP) siRNA
ggattacaggtgtgaaccactgc

SEQ ID NO: 17614 - DNA, 23 bp, Artificial Sequence
  X-linked inhibitor of apoptosis (XIAP) siRNA
gattacaggtgtgaaccactgct

SEQ ID NO: 17615 - DNA, 23 bp, Artificial Sequence
  X-linked inhibitor of apoptosis (XIAP) siRNA
attacaggtgtgaaccactgctc

SEQ ID NO: 17616 - DNA, 23 bp, Artificial Sequence
  X-linked inhibitor of apoptosis (XIAP) siRNA
ttacaggtgtgaaccactgctcc

SEQ ID NO: 17617 - DNA, 23 bp, Artificial Sequence
  X-linked inhibitor of apoptosis (XIAP) siRNA
tacaggtgtgaaccactgctccc

SEQ ID NO: 17618 - DNA, 23 bp, Artificial Sequence
  X-linked inhibitor of apoptosis (XIAP) siRNA
acaggtgtgaaccactgctcccg

SEQ ID NO: 17619 - DNA, 23 bp, Artificial Sequence
  X-linked inhibitor of apoptosis (XIAP) siRNA
caggtgtgaaccactgctcccgg

SEQ ID NO: 17620 - DNA, 23 bp, Artificial Sequence
  X-linked inhibitor of apoptosis (XIAP) siRNA
aggtgtgaaccactgctcccggc

SEQ ID NO: 17621 - DNA, 23 bp, Artificial Sequence
  X-linked inhibitor of apoptosis (XIAP) siRNA
ggtgtgaaccactgctcccggcc

SEQ ID NO: 17622 - DNA, 23 bp, Artificial Sequence
  X-linked inhibitor of apoptosis (XIAP) siRNA
gtgtgaaccactgctcccggcct

SEQ ID NO: 17623 - DNA, 23 bp, Artificial Sequence
  X-linked inhibitor of apoptosis (XIAP) siRNA
tgtgaaccactgctcccggcctt

SEQ ID NO: 17624 - DNA, 23 bp, Artificial Sequence
  X-linked inhibitor of apoptosis (XIAP) siRNA
gtgaaccactgctcccggccttg

SEQ ID NO: 17625 - DNA, 23 bp, Artificial Sequence
  X-linked inhibitor of apoptosis (XIAP) siRNA
tgaaccactgctcccggccttgt

SEQ ID NO: 17626 - DNA, 23 bp, Artificial Sequence
  X-linked inhibitor of apoptosis (XIAP) siRNA
gaaccactgctcccggccttgtg

SEQ ID NO: 17627 - DNA, 23 bp, Artificial Sequence
  X-linked inhibitor of apoptosis (XIAP) siRNA
aaccactgctcccggccttgtgt

SEQ ID NO: 17628 - DNA, 23 bp, Artificial Sequence
  X-linked inhibitor of apoptosis (XIAP) siRNA
accactgctcccggccttgtgtg

SEQ ID NO: 17629 - DNA, 23 bp, Artificial Sequence
  X-linked inhibitor of apoptosis (XIAP) siRNA
ccactgctcccggccttgtgtga

SEQ ID NO: 17630 - DNA, 23 bp, Artificial Sequence
  X-linked inhibitor of apoptosis (XIAP) siRNA
cactgctcccggccttgtgtgat

SEQ ID NO: 17631 - DNA, 23 bp, Artificial Sequence
  X-linked inhibitor of apoptosis (XIAP) siRNA
actgctcccggccttgtgtgatt

SEQ ID NO: 17632 - DNA, 23 bp, Artificial Sequence
  X-linked inhibitor of apoptosis (XIAP) siRNA
ctgctcccggccttgtgtgattt

SEQ ID NO: 17633 - DNA, 23 bp, Artificial Sequence
  X-linked inhibitor of apoptosis (XIAP) siRNA
tgctcccggccttgtgtgatttt

SEQ ID NO: 17634 - DNA, 23 bp, Artificial Sequence
  X-linked inhibitor of apoptosis (XIAP) siRNA
gctcccggccttgtgtgatttta

SEQ ID NO: 17635 - DNA, 23 bp, Artificial Sequence
  X-linked inhibitor of apoptosis (XIAP) siRNA
ctcccggccttgtgtgattttat

SEQ ID NO: 17636 - DNA, 23 bp, Artificial Sequence
  X-linked inhibitor of apoptosis (XIAP) siRNA
tcccggccttgtgtgattttatc

SEQ ID NO: 17637 - DNA, 23 bp, Artificial Sequence
  X-linked inhibitor of apoptosis (XIAP) siRNA
cccggccttgtgtgattttatct

SEQ ID NO: 17638 - DNA, 23 bp, Artificial Sequence
  X-linked inhibitor of apoptosis (XIAP) siRNA
ccggccttgtgtgattttatcta

SEQ ID NO: 17639 - DNA, 23 bp, Artificial Sequence
  X-linked inhibitor of apoptosis (XIAP) siRNA
cggccttgtgtgattttatctaa

SEQ ID NO: 17640 - DNA, 23 bp, Artificial Sequence
  X-linked inhibitor of apoptosis (XIAP) siRNA
ggccttgtgtgattttatctaag

SEQ ID NO: 17641 - DNA, 23 bp, Artificial Sequence
  X-linked inhibitor of apoptosis (XIAP) siRNA
gccttgtgtgattttatctaagg

SEQ ID NO: 17642 - DNA, 23 bp, Artificial Sequence
  X-linked inhibitor of apoptosis (XIAP) siRNA
ccttgtgtgattttatctaaggg

SEQ ID NO: 17643 - DNA, 23 bp, Artificial Sequence
  X-linked inhibitor of apoptosis (XIAP) siRNA
cttgtgtgattttatctaaggga

SEQ ID NO: 17644 - DNA, 23 bp, Artificial Sequence
  X-linked inhibitor of apoptosis (XIAP) siRNA
ttgtgtgattttatctaagggac

SEQ ID NO: 17645 - DNA, 23 bp, Artificial Sequence
  X-linked inhibitor of apoptosis (XIAP) siRNA
tgtgtgattttatctaagggact

SEQ ID NO: 17646 - DNA, 23 bp, Artificial Sequence
  X-linked inhibitor of apoptosis (XIAP) siRNA
gtgtgattttatctaagggactt

SEQ ID NO: 17647 - DNA, 23 bp, Artificial Sequence
  X-linked inhibitor of apoptosis (XIAP) siRNA
tgtgattttatctaagggactta

SEQ ID NO: 17648 - DNA, 23 bp, Artificial Sequence
  X-linked inhibitor of apoptosis (XIAP) siRNA
gtgattttatctaagggacttaa

SEQ ID NO: 17649 - DNA, 23 bp, Artificial Sequence
  X-linked inhibitor of apoptosis (XIAP) siRNA
tgattttatctaagggacttaag

SEQ ID NO: 17650 - DNA, 23 bp, Artificial Sequence
  X-linked inhibitor of apoptosis (XIAP) siRNA
gattttatctaagggacttaagc

SEQ ID NO: 17651 - DNA, 23 bp, Artificial Sequence
  X-linked inhibitor of apoptosis (XIAP) siRNA
attttatctaagggacttaagcg

SEQ ID NO: 17652 - DNA, 23 bp, Artificial Sequence
  X-linked inhibitor of apoptosis (XIAP) siRNA
ttttatctaagggacttaagcgt

SEQ ID NO: 17653 - DNA, 23 bp, Artificial Sequence
  X-linked inhibitor of apoptosis (XIAP) siRNA
tttatctaagggacttaagcgtc

SEQ ID NO: 17654 - DNA, 23 bp, Artificial Sequence
  X-linked inhibitor of apoptosis (XIAP) siRNA
ttatctaagggacttaagcgtcc

SEQ ID NO: 17655 - DNA, 23 bp, Artificial Sequence
  X-linked inhibitor of apoptosis (XIAP) siRNA
tatctaagggacttaagcgtcct

SEQ ID NO: 17656 - DNA, 23 bp, Artificial Sequence
  X-linked inhibitor of apoptosis (XIAP) siRNA
atctaagggacttaagcgtcctc

SEQ ID NO: 17657 - DNA, 23 bp, Artificial Sequence
  X-linked inhibitor of apoptosis (XIAP) siRNA
tctaagggacttaagcgtcctca

SEQ ID NO: 17658 - DNA, 23 bp, Artificial Sequence
  X-linked inhibitor of apoptosis (XIAP) siRNA
ctaagggacttaagcgtcctcag

SEQ ID NO: 17659 - DNA, 23 bp, Artificial Sequence
  X-linked inhibitor of apoptosis (XIAP) siRNA
taagggacttaagcgtcctcagg

SEQ ID NO: 17660 - DNA, 23 bp, Artificial Sequence
  X-linked inhibitor of apoptosis (XIAP) siRNA
aagggacttaagcgtcctcaggt

SEQ ID NO: 17661 - DNA, 23 bp, Artificial Sequence
  X-linked inhibitor of apoptosis (XIAP) siRNA
agggacttaagcgtcctcaggtc

SEQ ID NO: 17662 - DNA, 23 bp, Artificial Sequence
  X-linked inhibitor of apoptosis (XIAP) siRNA
gggacttaagcgtcctcaggtcc

SEQ ID NO: 17663 - DNA, 23 bp, Artificial Sequence
  X-linked inhibitor of apoptosis (XIAP) siRNA
ggacttaagcgtcctcaggtcct

SEQ ID NO: 17664 - DNA, 23 bp, Artificial Sequence
  X-linked inhibitor of apoptosis (XIAP) siRNA
gacttaagcgtcctcaggtccta

SEQ ID NO: 17665 - DNA, 23 bp, Artificial Sequence
  X-linked inhibitor of apoptosis (XIAP) siRNA
acttaagcgtcctcaggtcctag

SEQ ID NO: 17666 - DNA, 23 bp, Artificial Sequence
  X-linked inhibitor of apoptosis (XIAP) siRNA
cttaagcgtcctcaggtcctagg

SEQ ID NO: 17667 - DNA, 23 bp, Artificial Sequence
  X-linked inhibitor of apoptosis (XIAP) siRNA
ttaagcgtcctcaggtcctaggg

SEQ ID NO: 17668 - DNA, 23 bp, Artificial Sequence
  X-linked inhibitor of apoptosis (XIAP) siRNA
taagcgtcctcaggtcctagggg

SEQ ID NO: 17669 - DNA, 23 bp, Artificial Sequence
  X-linked inhibitor of apoptosis (XIAP) siRNA
aagcgtcctcaggtcctaggggg

SEQ ID NO: 17670 - DNA, 23 bp, Artificial Sequence
  X-linked inhibitor of apoptosis (XIAP) siRNA
agcgtcctcaggtcctagggggt

SEQ ID NO: 17671 - DNA, 23 bp, Artificial Sequence
  X-linked inhibitor of apoptosis (XIAP) siRNA
gcgtcctcaggtcctagggggtc

SEQ ID NO: 17672 - DNA, 23 bp, Artificial Sequence
  X-linked inhibitor of apoptosis (XIAP) siRNA
cgtcctcaggtcctagggggtcg

SEQ ID NO: 17673 - DNA, 23 bp, Artificial Sequence
  X-linked inhibitor of apoptosis (XIAP) siRNA
gtcctcaggtcctagggggtcgt

SEQ ID NO: 17674 - DNA, 23 bp, Artificial Sequence
  X-linked inhibitor of apoptosis (XIAP) siRNA
tcctcaggtcctagggggtcgtg

SEQ ID NO: 17675 - DNA, 23 bp, Artificial Sequence
  X-linked inhibitor of apoptosis (XIAP) siRNA
cctcaggtcctagggggtcgtga

SEQ ID NO: 17676 - DNA, 23 bp, Artificial Sequence
  X-linked inhibitor of apoptosis (XIAP) siRNA
ctcaggtcctagggggtcgtgaa

SEQ ID NO: 17677 - DNA, 23 bp, Artificial Sequence
  X-linked inhibitor of apoptosis (XIAP) siRNA
tcaggtcctagggggtcgtgaaa

SEQ ID NO: 17678 - DNA, 23 bp, Artificial Sequence
  X-linked inhibitor of apoptosis (XIAP) siRNA
caggtcctagggggtcgtgaaac

SEQ ID NO: 17679 - DNA, 23 bp, Artificial Sequence
  X-linked inhibitor of apoptosis (XIAP) siRNA
aggtcctagggggtcgtgaaacc

SEQ ID NO: 17680 - DNA, 23 bp, Artificial Sequence
  X-linked inhibitor of apoptosis (XIAP) siRNA
ggtcctagggggtcgtgaaacca

SEQ ID NO: 17681 - DNA, 23 bp, Artificial Sequence
  X-linked inhibitor of apoptosis (XIAP) siRNA
gtcctagggggtcgtgaaaccaa

SEQ ID NO: 17682 - DNA, 23 bp, Artificial Sequence
  X-linked inhibitor of apoptosis (XIAP) siRNA
tcctagggggtcgtgaaaccaaa

SEQ ID NO: 17683 - DNA, 23 bp, Artificial Sequence
  X-linked inhibitor of apoptosis (XIAP) siRNA
cctagggggtcgtgaaaccaaaa

SEQ ID NO: 17684 - DNA, 23 bp, Artificial Sequence
  X-linked inhibitor of apoptosis (XIAP) siRNA
ctagggggtcgtgaaaccaaaac

SEQ ID NO: 17685 - DNA, 23 bp, Artificial Sequence
  X-linked inhibitor of apoptosis (XIAP) siRNA
tagggggtcgtgaaaccaaaacc

SEQ ID NO: 17686 - DNA, 23 bp, Artificial Sequence
  X-linked inhibitor of apoptosis (XIAP) siRNA
agggggtcgtgaaaccaaaaccc

SEQ ID NO: 17687 - DNA, 23 bp, Artificial Sequence
  X-linked inhibitor of apoptosis (XIAP) siRNA
gggggtcgtgaaaccaaaacccc

SEQ ID NO: 17688 - DNA, 23 bp, Artificial Sequence
  X-linked inhibitor of apoptosis (XIAP) siRNA
ggggtcgtgaaaccaaaacccca

SEQ ID NO: 17689 - DNA, 23 bp, Artificial Sequence
  X-linked inhibitor of apoptosis (XIAP) siRNA
gggtcgtgaaaccaaaaccccag

SEQ ID NO: 17690 - DNA, 23 bp, Artificial Sequence
  X-linked inhibitor of apoptosis (XIAP) siRNA
ggtcgtgaaaccaaaaccccagg

SEQ ID NO: 17691 - DNA, 23 bp, Artificial Sequence
  X-linked inhibitor of apoptosis (XIAP) siRNA
gtcgtgaaaccaaaaccccaggg

SEQ ID NO: 17692 - DNA, 23 bp, Artificial Sequence
  X-linked inhibitor of apoptosis (XIAP) siRNA
tcgtgaaaccaaaaccccaggga

SEQ ID NO: 17693 - DNA, 23 bp, Artificial Sequence
  X-linked inhibitor of apoptosis (XIAP) siRNA
cgtgaaaccaaaaccccagggat

SEQ ID NO: 17694 - DNA, 23 bp, Artificial Sequence
  X-linked inhibitor of apoptosis (XIAP) siRNA
gtgaaaccaaaaccccagggata

SEQ ID NO: 17695 - DNA, 23 bp, Artificial Sequence
  X-linked inhibitor of apoptosis (XIAP) siRNA
tgaaaccaaaaccccagggatag

SEQ ID NO: 17696 - DNA, 23 bp, Artificial Sequence
  X-linked inhibitor of apoptosis (XIAP) siRNA
gaaaccaaaaccccagggatagc

SEQ ID NO: 17697 - DNA, 23 bp, Artificial Sequence
  X-linked inhibitor of apoptosis (XIAP) siRNA
aaaccaaaaccccagggatagca

SEQ ID NO: 17698 - DNA, 23 bp, Artificial Sequence
  X-linked inhibitor of apoptosis (XIAP) siRNA
aaccaaaaccccagggatagcaa

SEQ ID NO: 17699 - DNA, 23 bp, Artificial Sequence
  X-linked inhibitor of apoptosis (XIAP) siRNA
accaaaaccccagggatagcaag

SEQ ID NO: 17700 - DNA, 23 bp, Artificial Sequence
  X-linked inhibitor of apoptosis (XIAP) siRNA
ccaaaaccccagggatagcaagg

SEQ ID NO: 17701 - DNA, 23 bp, Artificial Sequence
  X-linked inhibitor of apoptosis (XIAP) siRNA
caaaaccccagggatagcaaggg

SEQ ID NO: 17702 - DNA, 23 bp, Artificial Sequence
  X-linked inhibitor of apoptosis (XIAP) siRNA
aaaaccccagggatagcaaggga

SEQ ID NO: 17703 - DNA, 23 bp, Artificial Sequence
  X-linked inhibitor of apoptosis (XIAP) siRNA
aaaccccagggatagcaagggac

SEQ ID NO: 17704 - DNA, 23 bp, Artificial Sequence
  X-linked inhibitor of apoptosis (XIAP) siRNA
aaccccagggatagcaagggaca

SEQ ID NO: 17705 - DNA, 23 bp, Artificial Sequence
  X-linked inhibitor of apoptosis (XIAP) siRNA
accccagggatagcaagggacaa

SEQ ID NO: 17706 - DNA, 23 bp, Artificial Sequence
  X-linked inhibitor of apoptosis (XIAP) siRNA
ccccagggatagcaagggacaat

SEQ ID NO: 17707 - DNA, 23 bp, Artificial Sequence
  X-linked inhibitor of apoptosis (XIAP) siRNA
cccagggatagcaagggacaatt

SEQ ID NO: 17708 - DNA, 23 bp, Artificial Sequence
  X-linked inhibitor of apoptosis (XIAP) siRNA
ccagggatagcaagggacaattg

SEQ ID NO: 17709 - DNA, 23 bp, Artificial Sequence
  X-linked inhibitor of apoptosis (XIAP) siRNA
cagggatagcaagggacaattgt

SEQ ID NO: 17710 - DNA, 23 bp, Artificial Sequence
  X-linked inhibitor of apoptosis (XIAP) siRNA
agggatagcaagggacaattgta

SEQ ID NO: 17711 - DNA, 23 bp, Artificial Sequence
  X-linked inhibitor of apoptosis (XIAP) siRNA
gggatagcaagggacaattgtat

SEQ ID NO: 17712 - DNA, 23 bp, Artificial Sequence
  X-linked inhibitor of apoptosis (XIAP) siRNA
ggatagcaagggacaattgtatc

SEQ ID NO: 17713 - DNA, 23 bp, Artificial Sequence
  X-linked inhibitor of apoptosis (XIAP) siRNA
gatagcaagggacaattgtatct

SEQ ID NO: 17714 - DNA, 23 bp, Artificial Sequence
  X-linked inhibitor of apoptosis (XIAP) siRNA
atagcaagggacaattgtatctt

SEQ ID NO: 17715 - DNA, 23 bp, Artificial Sequence
  X-linked inhibitor of apoptosis (XIAP) siRNA
tagcaagggacaattgtatcttc

SEQ ID NO: 17716 - DNA, 23 bp, Artificial Sequence
  X-linked inhibitor of apoptosis (XIAP) siRNA
agcaagggacaattgtatcttca

SEQ ID NO: 17717 - DNA, 23 bp, Artificial Sequence
  X-linked inhibitor of apoptosis (XIAP) siRNA
gcaagggacaattgtatcttcaa

SEQ ID NO: 17718 - DNA, 23 bp, Artificial Sequence
  X-linked inhibitor of apoptosis (XIAP) siRNA
caagggacaattgtatcttcaaa

SEQ ID NO: 17719 - DNA, 23 bp, Artificial Sequence
  X-linked inhibitor of apoptosis (XIAP) siRNA
aagggacaattgtatcttcaaag

SEQ ID NO: 17720 - DNA, 23 bp, Artificial Sequence
  X-linked inhibitor of apoptosis (XIAP) siRNA
agggacaattgtatcttcaaagt

SEQ ID NO: 17721 - DNA, 23 bp, Artificial Sequence
  X-linked inhibitor of apoptosis (XIAP) siRNA
gggacaattgtatcttcaaagta

SEQ ID NO: 17722 - DNA, 23 bp, Artificial Sequence
  X-linked inhibitor of apoptosis (XIAP) siRNA
ggacaattgtatcttcaaagtag

SEQ ID NO: 17723 - DNA, 23 bp, Artificial Sequence
  X-linked inhibitor of apoptosis (XIAP) siRNA
gacaattgtatcttcaaagtaga

SEQ ID NO: 17724 - DNA, 23 bp, Artificial Sequence
  X-linked inhibitor of apoptosis (XIAP) siRNA
acaattgtatcttcaaagtagac

SEQ ID NO: 17725 - DNA, 23 bp, Artificial Sequence
  X-linked inhibitor of apoptosis (XIAP) siRNA
caattgtatcttcaaagtagaca

SEQ ID NO: 17726 - DNA, 23 bp, Artificial Sequence
  X-linked inhibitor of apoptosis (XIAP) siRNA
aattgtatcttcaaagtagacaa

SEQ ID NO: 17727 - DNA, 23 bp, Artificial Sequence
  X-linked inhibitor of apoptosis (XIAP) siRNA
attgtatcttcaaagtagacaaa

SEQ ID NO: 17728 - DNA, 23 bp, Artificial Sequence
  X-linked inhibitor of apoptosis (XIAP) siRNA
ttgtatcttcaaagtagacaaat

SEQ ID NO: 17729 - DNA, 23 bp, Artificial Sequence
  X-linked inhibitor of apoptosis (XIAP) siRNA
tgtatcttcaaagtagacaaatg

SEQ ID NO: 17730 - DNA, 23 bp, Artificial Sequence
  X-linked inhibitor of apoptosis (XIAP) siRNA
gtatcttcaaagtagacaaatgg

SEQ ID NO: 17731 - DNA, 23 bp, Artificial Sequence
  X-linked inhibitor of apoptosis (XIAP) siRNA
tatcttcaaagtagacaaatggc

SEQ ID NO: 17732 - DNA, 23 bp, Artificial Sequence
  X-linked inhibitor of apoptosis (XIAP) siRNA
atcttcaaagtagacaaatggcg

SEQ ID NO: 17733 - DNA, 23 bp, Artificial Sequence
  X-linked inhibitor of apoptosis (XIAP) siRNA
tcttcaaagtagacaaatggcgc

SEQ ID NO: 17734 - DNA, 23 bp, Artificial Sequence
  X-linked inhibitor of apoptosis (XIAP) siRNA
cttcaaagtagacaaatggcgcc

SEQ ID NO: 17735 - DNA, 23 bp, Artificial Sequence
  X-linked inhibitor of apoptosis (XIAP) siRNA
ttcaaagtagacaaatggcgccg

SEQ ID NO: 17736 - DNA, 23 bp, Artificial Sequence
  X-linked inhibitor of apoptosis (XIAP) siRNA
tcaaagtagacaaatggcgccgg

SEQ ID NO: 17737 - DNA, 23 bp, Artificial Sequence
  X-linked inhibitor of apoptosis (XIAP) siRNA
cgccgggcacggtggctcacgcc

SEQ ID NO: 17738 - DNA, 23 bp, Artificial Sequence
  X-linked inhibitor of apoptosis (XIAP) siRNA
gccgggcacggtggctcacgcct

SEQ ID NO: 17739 - DNA, 23 bp, Artificial Sequence
  X-linked inhibitor of apoptosis (XIAP) siRNA
ccgggcacggtggctcacgcctg

SEQ ID NO: 17740 - DNA, 23 bp, Artificial Sequence
  X-linked inhibitor of apoptosis (XIAP) siRNA
cgggcacggtggctcacgcctgt

SEQ ID NO: 17741 - DNA, 23 bp, Artificial Sequence
  X-linked inhibitor of apoptosis (XIAP) siRNA
gggcacggtggctcacgcctgta

SEQ ID NO: 17742 - DNA, 23 bp, Artificial Sequence
  X-linked inhibitor of apoptosis (XIAP) siRNA
ggcacggtggctcacgcctgtaa

SEQ ID NO: 17743 - DNA, 23 bp, Artificial Sequence
  X-linked inhibitor of apoptosis (XIAP) siRNA
gcacggtggctcacgcctgtaat

SEQ ID NO: 17744 - DNA, 23 bp, Artificial Sequence
  X-linked inhibitor of apoptosis (XIAP) siRNA
cacggtggctcacgcctgtaatc

SEQ ID NO: 17745 - DNA, 23 bp, Artificial Sequence
  X-linked inhibitor of apoptosis (XIAP) siRNA
acggtggctcacgcctgtaatcc

SEQ ID NO: 17746 - DNA, 23 bp, Artificial Sequence
  X-linked inhibitor of apoptosis (XIAP) siRNA
cggtggctcacgcctgtaatccc

SEQ ID NO: 17747 - DNA, 23 bp, Artificial Sequence
  X-linked inhibitor of apoptosis (XIAP) siRNA
ggtggctcacgcctgtaatccca

SEQ ID NO: 17748 - DNA, 23 bp, Artificial Sequence
  X-linked inhibitor of apoptosis (XIAP) siRNA
gtggctcacgcctgtaatcccag

SEQ ID NO: 17749 - DNA, 23 bp, Artificial Sequence
  X-linked inhibitor of apoptosis (XIAP) siRNA
tggctcacgcctgtaatcccagc

SEQ ID NO: 17750 - DNA, 23 bp, Artificial Sequence
  X-linked inhibitor of apoptosis (XIAP) siRNA
ggctcacgcctgtaatcccagca

SEQ ID NO: 17751 - DNA, 23 bp, Artificial Sequence
  X-linked inhibitor of apoptosis (XIAP) siRNA
gctcacgcctgtaatcccagcag

SEQ ID NO: 17752 - DNA, 23 bp, Artificial Sequence
  X-linked inhibitor of apoptosis (XIAP) siRNA
ctcacgcctgtaatcccagcagt

SEQ ID NO: 17753 - DNA, 23 bp, Artificial Sequence
  X-linked inhibitor of apoptosis (XIAP) siRNA
tcacgcctgtaatcccagcagtt

SEQ ID NO: 17754 - DNA, 23 bp, Artificial Sequence
  X-linked inhibitor of apoptosis (XIAP) siRNA
cacgcctgtaatcccagcagttt

SEQ ID NO: 17755 - DNA, 23 bp, Artificial Sequence
  X-linked inhibitor of apoptosis (XIAP) siRNA
acgcctgtaatcccagcagtttc

SEQ ID NO: 17756 - DNA, 23 bp, Artificial Sequence
  X-linked inhibitor of apoptosis (XIAP) siRNA
cgcctgtaatcccagcagtttcc

SEQ ID NO: 17757 - DNA, 23 bp, Artificial Sequence
  X-linked inhibitor of apoptosis (XIAP) siRNA
gcctgtaatcccagcagtttccg

SEQ ID NO: 17758 - DNA, 23 bp, Artificial Sequence
  X-linked inhibitor of apoptosis (XIAP) siRNA
cctgtaatcccagcagtttccga

SEQ ID NO: 17759 - DNA, 23 bp, Artificial Sequence
  X-linked inhibitor of apoptosis (XIAP) siRNA
ctgtaatcccagcagtttccgag

SEQ ID NO: 17760 - DNA, 23 bp, Artificial Sequence
  X-linked inhibitor of apoptosis (XIAP) siRNA
tgtaatcccagcagtttccgagg

SEQ ID NO: 17761 - DNA, 23 bp, Artificial Sequence
  X-linked inhibitor of apoptosis (XIAP) siRNA
gtaatcccagcagtttccgaggc

SEQ ID NO: 17762 - DNA, 23 bp, Artificial Sequence
  X-linked inhibitor of apoptosis (XIAP) siRNA
taatcccagcagtttccgaggct

SEQ ID NO: 17763 - DNA, 23 bp, Artificial Sequence
  X-linked inhibitor of apoptosis (XIAP) siRNA
aatcccagcagtttccgaggctg

SEQ ID NO: 17764 - DNA, 23 bp, Artificial Sequence
  X-linked inhibitor of apoptosis (XIAP) siRNA
atcccagcagtttccgaggctga

SEQ ID NO: 17765 - DNA, 23 bp, Artificial Sequence
  X-linked inhibitor of apoptosis (XIAP) siRNA
tcccagcagtttccgaggctgag

SEQ ID NO: 17766 - DNA, 23 bp, Artificial Sequence
  X-linked inhibitor of apoptosis (XIAP) siRNA
cccagcagtttccgaggctgagg

SEQ ID NO: 17767 - DNA, 23 bp, Artificial Sequence
  X-linked inhibitor of apoptosis (XIAP) siRNA
ccagcagtttccgaggctgaggc

SEQ ID NO: 17768 - DNA, 23 bp, Artificial Sequence
  X-linked inhibitor of apoptosis (XIAP) siRNA
cagcagtttccgaggctgaggca

SEQ ID NO: 17769 - DNA, 23 bp, Artificial Sequence
  X-linked inhibitor of apoptosis (XIAP) siRNA
agcagtttccgaggctgaggcag

SEQ ID NO: 17770 - DNA, 23 bp, Artificial Sequence
  X-linked inhibitor of apoptosis (XIAP) siRNA
gcagtttccgaggctgaggcagg

SEQ ID NO: 17771 - DNA, 23 bp, Artificial Sequence
  X-linked inhibitor of apoptosis (XIAP) siRNA
cagtttccgaggctgaggcaggc

SEQ ID NO: 17772 - DNA, 23 bp, Artificial Sequence
  X-linked inhibitor of apoptosis (XIAP) siRNA
agtttccgaggctgaggcaggcg

SEQ ID NO: 17773 - DNA, 23 bp, Artificial Sequence
  X-linked inhibitor of apoptosis (XIAP) siRNA
gtttccgaggctgaggcaggcgg

SEQ ID NO: 17774 - DNA, 23 bp, Artificial Sequence
  X-linked inhibitor of apoptosis (XIAP) siRNA
tttccgaggctgaggcaggcggc

SEQ ID NO: 17775 - DNA, 23 bp, Artificial Sequence
  X-linked inhibitor of apoptosis (XIAP) siRNA
ttccgaggctgaggcaggcggct

SEQ ID NO: 17776 - DNA, 23 bp, Artificial Sequence
  X-linked inhibitor of apoptosis (XIAP) siRNA
tccgaggctgaggcaggcggctc

SEQ ID NO: 17777 - DNA, 23 bp, Artificial Sequence
  X-linked inhibitor of apoptosis (XIAP) siRNA
ccgaggctgaggcaggcggctca

SEQ ID NO: 17778 - DNA, 23 bp, Artificial Sequence
  X-linked inhibitor of apoptosis (XIAP) siRNA
cgaggctgaggcaggcggctcac

SEQ ID NO: 17779 - DNA, 23 bp, Artificial Sequence
  X-linked inhibitor of apoptosis (XIAP) siRNA
gaggctgaggcaggcggctcacc

SEQ ID NO: 17780 - DNA, 23 bp, Artificial Sequence
  X-linked inhibitor of apoptosis (XIAP) siRNA
aggctgaggcaggcggctcacct

SEQ ID NO: 17781 - DNA, 23 bp, Artificial Sequence
  X-linked inhibitor of apoptosis (XIAP) siRNA
ggctgaggcaggcggctcacctg

SEQ ID NO: 17782 - DNA, 23 bp, Artificial Sequence
  X-linked inhibitor of apoptosis (XIAP) siRNA
gctgaggcaggcggctcacctga

SEQ ID NO: 17783 - DNA, 23 bp, Artificial Sequence
  X-linked inhibitor of apoptosis (XIAP) siRNA
ctgaggcaggcggctcacctgag

SEQ ID NO: 17784 - DNA, 23 bp, Artificial Sequence
  X-linked inhibitor of apoptosis (XIAP) siRNA
tgaggcaggcggctcacctgagg

SEQ ID NO: 17785 - DNA, 23 bp, Artificial Sequence
  X-linked inhibitor of apoptosis (XIAP) siRNA
gaggcaggcggctcacctgaggt

SEQ ID NO: 17786 - DNA, 23 bp, Artificial Sequence
  X-linked inhibitor of apoptosis (XIAP) siRNA
aggcaggcggctcacctgaggtc

SEQ ID NO: 17787 - DNA, 23 bp, Artificial Sequence
  X-linked inhibitor of apoptosis (XIAP) siRNA
ggcaggcggctcacctgaggtca

SEQ ID NO: 17788 - DNA, 23 bp, Artificial Sequence
  X-linked inhibitor of apoptosis (XIAP) siRNA
gcaggcggctcacctgaggtcag

SEQ ID NO: 17789 - DNA, 23 bp, Artificial Sequence
  X-linked inhibitor of apoptosis (XIAP) siRNA
caggcggctcacctgaggtcagg

SEQ ID NO: 17790 - DNA, 23 bp, Artificial Sequence
  X-linked inhibitor of apoptosis (XIAP) siRNA
aggcggctcacctgaggtcagga

SEQ ID NO: 17791 - DNA, 23 bp, Artificial Sequence
  X-linked inhibitor of apoptosis (XIAP) siRNA
ggcggctcacctgaggtcaggag

SEQ ID NO: 17792 - DNA, 23 bp, Artificial Sequence
  X-linked inhibitor of apoptosis (XIAP) siRNA
gcggctcacctgaggtcaggagt

SEQ ID NO: 17793 - DNA, 23 bp, Artificial Sequence
  X-linked inhibitor of apoptosis (XIAP) siRNA
cggctcacctgaggtcaggagtt

SEQ ID NO: 17794 - DNA, 23 bp, Artificial Sequence
  X-linked inhibitor of apoptosis (XIAP) siRNA
ggctcacctgaggtcaggagttg

SEQ ID NO: 17795 - DNA, 23 bp, Artificial Sequence
  X-linked inhibitor of apoptosis (XIAP) siRNA
gctcacctgaggtcaggagttgg

SEQ ID NO: 17796 - DNA, 23 bp, Artificial Sequence
  X-linked inhibitor of apoptosis (XIAP) siRNA
ctcacctgaggtcaggagttgga

SEQ ID NO: 17797 - DNA, 23 bp, Artificial Sequence
  X-linked inhibitor of apoptosis (XIAP) siRNA
tcacctgaggtcaggagttggag

SEQ ID NO: 17798 - DNA, 23 bp, Artificial Sequence
  X-linked inhibitor of apoptosis (XIAP) siRNA
cacctgaggtcaggagttggaga

SEQ ID NO: 17799 - DNA, 23 bp, Artificial Sequence
  X-linked inhibitor of apoptosis (XIAP) siRNA
acctgaggtcaggagttggagac

SEQ ID NO: 17800 - DNA, 23 bp, Artificial Sequence
  X-linked inhibitor of apoptosis (XIAP) siRNA
cctgaggtcaggagttggagacc

SEQ ID NO: 17801 - DNA, 23 bp, Artificial Sequence
  X-linked inhibitor of apoptosis (XIAP) siRNA
ctgaggtcaggagttggagacca

SEQ ID NO: 17802 - DNA, 23 bp, Artificial Sequence
  X-linked inhibitor of apoptosis (XIAP) siRNA
tgaggtcaggagttggagaccag

SEQ ID NO: 17803 - DNA, 23 bp, Artificial Sequence
  X-linked inhibitor of apoptosis (XIAP) siRNA
gaggtcaggagttggagaccagc

SEQ ID NO: 17804 - DNA, 23 bp, Artificial Sequence
  X-linked inhibitor of apoptosis (XIAP) siRNA
aggtcaggagttggagaccagcc

SEQ ID NO: 17805 - DNA, 23 bp, Artificial Sequence
  X-linked inhibitor of apoptosis (XIAP) siRNA
ggtcaggagttggagaccagcct

SEQ ID NO: 17806 - DNA, 23 bp, Artificial Sequence
  X-linked inhibitor of apoptosis (XIAP) siRNA
gtcaggagttggagaccagcctg

SEQ ID NO: 17807 - DNA, 23 bp, Artificial Sequence
  X-linked inhibitor of apoptosis (XIAP) siRNA
tcaggagttggagaccagcctgg

SEQ ID NO: 17808 - DNA, 23 bp, Artificial Sequence
  X-linked inhibitor of apoptosis (XIAP) siRNA
caggagttggagaccagcctggc

SEQ ID NO: 17809 - DNA, 23 bp, Artificial Sequence
  X-linked inhibitor of apoptosis (XIAP) siRNA
aggagttggagaccagcctggcc

SEQ ID NO: 17810 - DNA, 23 bp, Artificial Sequence
  X-linked inhibitor of apoptosis (XIAP) siRNA
ggagttggagaccagcctggcca

SEQ ID NO: 17811 - DNA, 23 bp, Artificial Sequence
  X-linked inhibitor of apoptosis (XIAP) siRNA
gagttggagaccagcctggccaa

SEQ ID NO: 17812 - DNA, 23 bp, Artificial Sequence
  X-linked inhibitor of apoptosis (XIAP) siRNA
agttggagaccagcctggccaac

SEQ ID NO: 17813 - DNA, 23 bp, Artificial Sequence
  X-linked inhibitor of apoptosis (XIAP) siRNA
gttggagaccagcctggccaaca

SEQ ID NO: 17814 - DNA, 23 bp, Artificial Sequence
  X-linked inhibitor of apoptosis (XIAP) siRNA
ttggagaccagcctggccaacat

SEQ ID NO: 17815 - DNA, 23 bp, Artificial Sequence
  X-linked inhibitor of apoptosis (XIAP) siRNA
tggagaccagcctggccaacatg

SEQ ID NO: 17816 - DNA, 23 bp, Artificial Sequence
  X-linked inhibitor of apoptosis (XIAP) siRNA
ggagaccagcctggccaacatgc

SEQ ID NO: 17817 - DNA, 23 bp, Artificial Sequence
  X-linked inhibitor of apoptosis (XIAP) siRNA
gagaccagcctggccaacatgct

SEQ ID NO: 17818 - DNA, 23 bp, Artificial Sequence
  X-linked inhibitor of apoptosis (XIAP) siRNA
agaccagcctggccaacatgctg

SEQ ID NO: 17819 - DNA, 23 bp, Artificial Sequence
  X-linked inhibitor of apoptosis (XIAP) siRNA
gaccagcctggccaacatgctga

SEQ ID NO: 17820 - DNA, 23 bp, Artificial Sequence
  X-linked inhibitor of apoptosis (XIAP) siRNA
accagcctggccaacatgctgaa

SEQ ID NO: 17821 - DNA, 23 bp, Artificial Sequence
  X-linked inhibitor of apoptosis (XIAP) siRNA
ccagcctggccaacatgctgaaa

SEQ ID NO: 17822 - DNA, 23 bp, Artificial Sequence
  X-linked inhibitor of apoptosis (XIAP) siRNA
cagcctggccaacatgctgaaac

SEQ ID NO: 17823 - DNA, 23 bp, Artificial Sequence
  X-linked inhibitor of apoptosis (XIAP) siRNA
agcctggccaacatgctgaaacc

SEQ ID NO: 17824 - DNA, 23 bp, Artificial Sequence
  X-linked inhibitor of apoptosis (XIAP) siRNA
gcctggccaacatgctgaaaccc

SEQ ID NO: 17825 - DNA, 23 bp, Artificial Sequence
  X-linked inhibitor of apoptosis (XIAP) siRNA
cctggccaacatgctgaaaccct

SEQ ID NO: 17826 - DNA, 23 bp, Artificial Sequence
  X-linked inhibitor of apoptosis (XIAP) siRNA
ctggccaacatgctgaaaccctg

SEQ ID NO: 17827 - DNA, 23 bp, Artificial Sequence
  X-linked inhibitor of apoptosis (XIAP) siRNA
tggccaacatgctgaaaccctgt

SEQ ID NO: 17828 - DNA, 23 bp, Artificial Sequence
  X-linked inhibitor of apoptosis (XIAP) siRNA
ggccaacatgctgaaaccctgtc

SEQ ID NO: 17829 - DNA, 23 bp, Artificial Sequence
  X-linked inhibitor of apoptosis (XIAP) siRNA
gccaacatgctgaaaccctgtct

SEQ ID NO: 17830 - DNA, 23 bp, Artificial Sequence
  X-linked inhibitor of apoptosis (XIAP) siRNA
ccaacatgctgaaaccctgtctg

SEQ ID NO: 17831 - DNA, 23 bp, Artificial Sequence
  X-linked inhibitor of apoptosis (XIAP) siRNA
caacatgctgaaaccctgtctgt

SEQ ID NO: 17832 - DNA, 23 bp, Artificial Sequence
  X-linked inhibitor of apoptosis (XIAP) siRNA
aacatgctgaaaccctgtctgta

SEQ ID NO: 17833 - DNA, 23 bp, Artificial Sequence
  X-linked inhibitor of apoptosis (XIAP) siRNA
acatgctgaaaccctgtctgtac

SEQ ID NO: 17834 - DNA, 23 bp, Artificial Sequence
  X-linked inhibitor of apoptosis (XIAP) siRNA
catgctgaaaccctgtctgtaca

SEQ ID NO: 17835 - DNA, 23 bp, Artificial Sequence
  X-linked inhibitor of apoptosis (XIAP) siRNA
atgctgaaaccctgtctgtacaa

SEQ ID NO: 17836 - DNA, 23 bp, Artificial Sequence
  X-linked inhibitor of apoptosis (XIAP) siRNA
tgctgaaaccctgtctgtacaaa

SEQ ID NO: 17837 - DNA, 23 bp, Artificial Sequence
  X-linked inhibitor of apoptosis (XIAP) siRNA
gctgaaaccctgtctgtacaaaa

SEQ ID NO: 17838 - DNA, 23 bp, Artificial Sequence
  X-linked inhibitor of apoptosis (XIAP) siRNA
ctgaaaccctgtctgtacaaaaa

SEQ ID NO: 17839 - DNA, 23 bp, Artificial Sequence
  X-linked inhibitor of apoptosis (XIAP) siRNA
tgaaaccctgtctgtacaaaaat

SEQ ID NO: 17840 - DNA, 23 bp, Artificial Sequence
  X-linked inhibitor of apoptosis (XIAP) siRNA
gaaaccctgtctgtacaaaaata

SEQ ID NO: 17841 - DNA, 23 bp, Artificial Sequence
  X-linked inhibitor of apoptosis (XIAP) siRNA
aaaccctgtctgtacaaaaatac

SEQ ID NO: 17842 - DNA, 23 bp, Artificial Sequence
  X-linked inhibitor of apoptosis (XIAP) siRNA
aaccctgtctgtacaaaaataca

SEQ ID NO: 17843 - DNA, 23 bp, Artificial Sequence
  X-linked inhibitor of apoptosis (XIAP) siRNA
accctgtctgtacaaaaatacaa

SEQ ID NO: 17844 - DNA, 23 bp, Artificial Sequence
  X-linked inhibitor of apoptosis (XIAP) siRNA
ccctgtctgtacaaaaatacaaa

SEQ ID NO: 17845 - DNA, 23 bp, Artificial Sequence
  X-linked inhibitor of apoptosis (XIAP) siRNA
cctgtctgtacaaaaatacaaaa

SEQ ID NO: 17846 - DNA, 23 bp, Artificial Sequence
  X-linked inhibitor of apoptosis (XIAP) siRNA
ctgtctgtacaaaaatacaaaaa

SEQ ID NO: 17847 - DNA, 23 bp, Artificial Sequence
  X-linked inhibitor of apoptosis (XIAP) siRNA
tgtctgtacaaaaatacaaaaat

SEQ ID NO: 17848 - DNA, 23 bp, Artificial Sequence
  X-linked inhibitor of apoptosis (XIAP) siRNA
gtctgtacaaaaatacaaaaata

SEQ ID NO: 17849 - DNA, 23 bp, Artificial Sequence
  X-linked inhibitor of apoptosis (XIAP) siRNA
tctgtacaaaaatacaaaaatag

SEQ ID NO: 17850 - DNA, 23 bp, Artificial Sequence
  X-linked inhibitor of apoptosis (XIAP) siRNA
ctgtacaaaaatacaaaaatagc

SEQ ID NO: 17851 - DNA, 23 bp, Artificial Sequence
  X-linked inhibitor of apoptosis (XIAP) siRNA
tgtacaaaaatacaaaaatagct

SEQ ID NO: 17852 - DNA, 23 bp, Artificial Sequence
  X-linked inhibitor of apoptosis (XIAP) siRNA
gtacaaaaatacaaaaatagctg

SEQ ID NO: 17853 - DNA, 23 bp, Artificial Sequence
  X-linked inhibitor of apoptosis (XIAP) siRNA
tacaaaaatacaaaaatagctgg

SEQ ID NO: 17854 - DNA, 23 bp, Artificial Sequence
  X-linked inhibitor of apoptosis (XIAP) siRNA
acaaaaatacaaaaatagctggg

SEQ ID NO: 17855 - DNA, 23 bp, Artificial Sequence
  X-linked inhibitor of apoptosis (XIAP) siRNA
caaaaatacaaaaatagctgggc

SEQ ID NO: 17856 - DNA, 23 bp, Artificial Sequence
  X-linked inhibitor of apoptosis (XIAP) siRNA
aaaaatacaaaaatagctgggca

SEQ ID NO: 17857 - DNA, 23 bp, Artificial Sequence
  X-linked inhibitor of apoptosis (XIAP) siRNA
aaaatacaaaaatagctgggcat

SEQ ID NO: 17858 - DNA, 23 bp, Artificial Sequence
  X-linked inhibitor of apoptosis (XIAP) siRNA
aaatacaaaaatagctgggcatg

SEQ ID NO: 17859 - DNA, 23 bp, Artificial Sequence
  X-linked inhibitor of apoptosis (XIAP) siRNA
aatacaaaaatagctgggcatgg

SEQ ID NO: 17860 - DNA, 23 bp, Artificial Sequence
  X-linked inhibitor of apoptosis (XIAP) siRNA
atacaaaaatagctgggcatggt

SEQ ID NO: 17861 - DNA, 23 bp, Artificial Sequence
  X-linked inhibitor of apoptosis (XIAP) siRNA
tacaaaaatagctgggcatggtg

SEQ ID NO: 17862 - DNA, 23 bp, Artificial Sequence
  X-linked inhibitor of apoptosis (XIAP) siRNA
acaaaaatagctgggcatggtgg

SEQ ID NO: 17863 - DNA, 23 bp, Artificial Sequence
  X-linked inhibitor of apoptosis (XIAP) siRNA
caaaaatagctgggcatggtggc

SEQ ID NO: 17864 - DNA, 23 bp, Artificial Sequence
  X-linked inhibitor of apoptosis (XIAP) siRNA
aaaaatagctgggcatggtggcg

SEQ ID NO: 17865 - DNA, 23 bp, Artificial Sequence
  X-linked inhibitor of apoptosis (XIAP) siRNA
aaaatagctgggcatggtggcgc

SEQ ID NO: 17866 - DNA, 23 bp, Artificial Sequence
  X-linked inhibitor of apoptosis (XIAP) siRNA
aaatagctgggcatggtggcgca

SEQ ID NO: 17867 - DNA, 23 bp, Artificial Sequence
  X-linked inhibitor of apoptosis (XIAP) siRNA
aatagctgggcatggtggcgcat

SEQ ID NO: 17868 - DNA, 23 bp, Artificial Sequence
  X-linked inhibitor of apoptosis (XIAP) siRNA
atagctgggcatggtggcgcatg

SEQ ID NO: 17869 - DNA, 23 bp, Artificial Sequence
  X-linked inhibitor of apoptosis (XIAP) siRNA
tagctgggcatggtggcgcatgc

SEQ ID NO: 17870 - DNA, 23 bp, Artificial Sequence
  X-linked inhibitor of apoptosis (XIAP) siRNA
agctgggcatggtggcgcatgcc

SEQ ID NO: 17871 - DNA, 23 bp, Artificial Sequence
  X-linked inhibitor of apoptosis (XIAP) siRNA
gctgggcatggtggcgcatgcct

SEQ ID NO: 17872 - DNA, 23 bp, Artificial Sequence
  X-linked inhibitor of apoptosis (XIAP) siRNA
ctgggcatggtggcgcatgcctg

SEQ ID NO: 17873 - DNA, 23 bp, Artificial Sequence
  X-linked inhibitor of apoptosis (XIAP) siRNA
tgggcatggtggcgcatgcctgt

SEQ ID NO: 17874 - DNA, 23 bp, Artificial Sequence
  X-linked inhibitor of apoptosis (XIAP) siRNA
gggcatggtggcgcatgcctgta

SEQ ID NO: 17875 - DNA, 23 bp, Artificial Sequence
  X-linked inhibitor of apoptosis (XIAP) siRNA
ggcatggtggcgcatgcctgtag

SEQ ID NO: 17876 - DNA, 23 bp, Artificial Sequence
  X-linked inhibitor of apoptosis (XIAP) siRNA
gcatggtggcgcatgcctgtagt

SEQ ID NO: 17877 - DNA, 23 bp, Artificial Sequence
  X-linked inhibitor of apoptosis (XIAP) siRNA
catggtggcgcatgcctgtagtc

SEQ ID NO: 17878 - DNA, 23 bp, Artificial Sequence
  X-linked inhibitor of apoptosis (XIAP) siRNA
atggtggcgcatgcctgtagtcc

SEQ ID NO: 17879 - DNA, 23 bp, Artificial Sequence
  X-linked inhibitor of apoptosis (XIAP) siRNA
tggtggcgcatgcctgtagtccc

SEQ ID NO: 17880 - DNA, 23 bp, Artificial Sequence
  X-linked inhibitor of apoptosis (XIAP) siRNA
ggtggcgcatgcctgtagtccca

SEQ ID NO: 17881 - DNA, 23 bp, Artificial Sequence
  X-linked inhibitor of apoptosis (XIAP) siRNA
gtggcgcatgcctgtagtcccag

SEQ ID NO: 17882 - DNA, 23 bp, Artificial Sequence
  X-linked inhibitor of apoptosis (XIAP) siRNA
tggcgcatgcctgtagtcccagc

SEQ ID NO: 17883 - DNA, 23 bp, Artificial Sequence
  X-linked inhibitor of apoptosis (XIAP) siRNA
ggcgcatgcctgtagtcccagct

SEQ ID NO: 17884 - DNA, 23 bp, Artificial Sequence
  X-linked inhibitor of apoptosis (XIAP) siRNA
gcgcatgcctgtagtcccagcta

SEQ ID NO: 17885 - DNA, 23 bp, Artificial Sequence
  X-linked inhibitor of apoptosis (XIAP) siRNA
cgcatgcctgtagtcccagctac

SEQ ID NO: 17886 - DNA, 23 bp, Artificial Sequence
  X-linked inhibitor of apoptosis (XIAP) siRNA
gcatgcctgtagtcccagctact

SEQ ID NO: 17887 - DNA, 23 bp, Artificial Sequence
  X-linked inhibitor of apoptosis (XIAP) siRNA
catgcctgtagtcccagctacta

SEQ ID NO: 17888 - DNA, 23 bp, Artificial Sequence
  X-linked inhibitor of apoptosis (XIAP) siRNA
atgcctgtagtcccagctactag

SEQ ID NO: 17889 - DNA, 23 bp, Artificial Sequence
  X-linked inhibitor of apoptosis (XIAP) siRNA
tgcctgtagtcccagctactaga

SEQ ID NO: 17890 - DNA, 23 bp, Artificial Sequence
  X-linked inhibitor of apoptosis (XIAP) siRNA
gcctgtagtcccagctactagag

SEQ ID NO: 17891 - DNA, 23 bp, Artificial Sequence
  X-linked inhibitor of apoptosis (XIAP) siRNA
cctgtagtcccagctactagagc

SEQ ID NO: 17892 - DNA, 23 bp, Artificial Sequence
  X-linked inhibitor of apoptosis (XIAP) siRNA
ctgtagtcccagctactagagcg

SEQ ID NO: 17893 - DNA, 23 bp, Artificial Sequence
  X-linked inhibitor of apoptosis (XIAP) siRNA
tgtagtcccagctactagagcga

SEQ ID NO: 17894 - DNA, 23 bp, Artificial Sequence
  X-linked inhibitor of apoptosis (XIAP) siRNA
gtagtcccagctactagagcgac

SEQ ID NO: 17895 - DNA, 23 bp, Artificial Sequence
  X-linked inhibitor of apoptosis (XIAP) siRNA
tagtcccagctactagagcgact

SEQ ID NO: 17896 - DNA, 23 bp, Artificial Sequence
  X-linked inhibitor of apoptosis (XIAP) siRNA
agtcccagctactagagcgactg

SEQ ID NO: 17897 - DNA, 23 bp, Artificial Sequence
  X-linked inhibitor of apoptosis (XIAP) siRNA
gtcccagctactagagcgactga

SEQ ID NO: 17898 - DNA, 23 bp, Artificial Sequence
  X-linked inhibitor of apoptosis (XIAP) siRNA
tcccagctactagagcgactgag

SEQ ID NO: 17899 - DNA, 23 bp, Artificial Sequence
  X-linked inhibitor of apoptosis (XIAP) siRNA
cccagctactagagcgactgagg

SEQ ID NO: 17900 - DNA, 23 bp, Artificial Sequence
  X-linked inhibitor of apoptosis (XIAP) siRNA
ccagctactagagcgactgaggc

SEQ ID NO: 17901 - DNA, 23 bp, Artificial Sequence
  X-linked inhibitor of apoptosis (XIAP) siRNA
cagctactagagcgactgaggca

SEQ ID NO: 17902 - DNA, 23 bp, Artificial Sequence
  X-linked inhibitor of apoptosis (XIAP) siRNA
agctactagagcgactgaggcag

SEQ ID NO: 17903 - DNA, 23 bp, Artificial Sequence
  X-linked inhibitor of apoptosis (XIAP) siRNA
gctactagagcgactgaggcagg

SEQ ID NO: 17904 - DNA, 23 bp, Artificial Sequence
  X-linked inhibitor of apoptosis (XIAP) siRNA
ctactagagcgactgaggcagga

SEQ ID NO: 17905 - DNA, 23 bp, Artificial Sequence
  X-linked inhibitor of apoptosis (XIAP) siRNA
tactagagcgactgaggcaggag

SEQ ID NO: 17906 - DNA, 23 bp, Artificial Sequence
  X-linked inhibitor of apoptosis (XIAP) siRNA
actagagcgactgaggcaggaga

SEQ ID NO: 17907 - DNA, 23 bp, Artificial Sequence
  X-linked inhibitor of apoptosis (XIAP) siRNA
ctagagcgactgaggcaggagaa

SEQ ID NO: 17908 - DNA, 23 bp, Artificial Sequence
  X-linked inhibitor of apoptosis (XIAP) siRNA
tagagcgactgaggcaggagaat

SEQ ID NO: 17909 - DNA, 23 bp, Artificial Sequence
  X-linked inhibitor of apoptosis (XIAP) siRNA
agagcgactgaggcaggagaatt

SEQ ID NO: 17910 - DNA, 23 bp, Artificial Sequence
  X-linked inhibitor of apoptosis (XIAP) siRNA
gagcgactgaggcaggagaattg

SEQ ID NO: 17911 - DNA, 23 bp, Artificial Sequence
  X-linked inhibitor of apoptosis (XIAP) siRNA
agcgactgaggcaggagaattgc

SEQ ID NO: 17912 - DNA, 23 bp, Artificial Sequence
  X-linked inhibitor of apoptosis (XIAP) siRNA
gcgactgaggcaggagaattgct

SEQ ID NO: 17913 - DNA, 23 bp, Artificial Sequence
  X-linked inhibitor of apoptosis (XIAP) siRNA
cgactgaggcaggagaattgctt

SEQ ID NO: 17914 - DNA, 23 bp, Artificial Sequence
  X-linked inhibitor of apoptosis (XIAP) siRNA
gactgaggcaggagaattgcttg

SEQ ID NO: 17915 - DNA, 23 bp, Artificial Sequence
  X-linked inhibitor of apoptosis (XIAP) siRNA
actgaggcaggagaattgcttga

SEQ ID NO: 17916 - DNA, 23 bp, Artificial Sequence
  X-linked inhibitor of apoptosis (XIAP) siRNA
ctgaggcaggagaattgcttgaa

SEQ ID NO: 17917 - DNA, 23 bp, Artificial Sequence
  X-linked inhibitor of apoptosis (XIAP) siRNA
tgaggcaggagaattgcttgaac

SEQ ID NO: 17918 - DNA, 23 bp, Artificial Sequence
  X-linked inhibitor of apoptosis (XIAP) siRNA
gaggcaggagaattgcttgaacc

SEQ ID NO: 17919 - DNA, 23 bp, Artificial Sequence
  X-linked inhibitor of apoptosis (XIAP) siRNA
aggcaggagaattgcttgaacct

SEQ ID NO: 17920 - DNA, 23 bp, Artificial Sequence
  X-linked inhibitor of apoptosis (XIAP) siRNA
ggcaggagaattgcttgaacctg

SEQ ID NO: 17921 - DNA, 23 bp, Artificial Sequence
  X-linked inhibitor of apoptosis (XIAP) siRNA
gcaggagaattgcttgaacctgg

SEQ ID NO: 17922 - DNA, 23 bp, Artificial Sequence
  X-linked inhibitor of apoptosis (XIAP) siRNA
caggagaattgcttgaacctggg

SEQ ID NO: 17923 - DNA, 23 bp, Artificial Sequence
  X-linked inhibitor of apoptosis (XIAP) siRNA
aggagaattgcttgaacctggga

SEQ ID NO: 17924 - DNA, 23 bp, Artificial Sequence
  X-linked inhibitor of apoptosis (XIAP) siRNA
ggagaattgcttgaacctgggag

SEQ ID NO: 17925 - DNA, 23 bp, Artificial Sequence
  X-linked inhibitor of apoptosis (XIAP) siRNA
gagaattgcttgaacctgggagg

SEQ ID NO: 17926 - DNA, 23 bp, Artificial Sequence
  X-linked inhibitor of apoptosis (XIAP) siRNA
agaattgcttgaacctgggaggc

SEQ ID NO: 17927 - DNA, 23 bp, Artificial Sequence
  X-linked inhibitor of apoptosis (XIAP) siRNA
gaattgcttgaacctgggaggcg

SEQ ID NO: 17928 - DNA, 23 bp, Artificial Sequence
  X-linked inhibitor of apoptosis (XIAP) siRNA
aattgcttgaacctgggaggcgg

SEQ ID NO: 17929 - DNA, 23 bp, Artificial Sequence
  X-linked inhibitor of apoptosis (XIAP) siRNA
attgcttgaacctgggaggcgga

SEQ ID NO: 17930 - DNA, 23 bp, Artificial Sequence
  X-linked inhibitor of apoptosis (XIAP) siRNA
ttgcttgaacctgggaggcggag

SEQ ID NO: 17931 - DNA, 23 bp, Artificial Sequence
  X-linked inhibitor of apoptosis (XIAP) siRNA
tgcttgaacctgggaggcggagg

SEQ ID NO: 17932 - DNA, 23 bp, Artificial Sequence
  X-linked inhibitor of apoptosis (XIAP) siRNA
gcttgaacctgggaggcggaggt

SEQ ID NO: 17933 - DNA, 23 bp, Artificial Sequence
  X-linked inhibitor of apoptosis (XIAP) siRNA
cttgaacctgggaggcggaggtt

SEQ ID NO: 17934 - DNA, 23 bp, Artificial Sequence
  X-linked inhibitor of apoptosis (XIAP) siRNA
ttgaacctgggaggcggaggttg

SEQ ID NO: 17935 - DNA, 23 bp, Artificial Sequence
  X-linked inhibitor of apoptosis (XIAP) siRNA
tgaacctgggaggcggaggttgc

SEQ ID NO: 17936 - DNA, 23 bp, Artificial Sequence
  X-linked inhibitor of apoptosis (XIAP) siRNA
gaacctgggaggcggaggttgca

SEQ ID NO: 17937 - DNA, 23 bp, Artificial Sequence
  X-linked inhibitor of apoptosis (XIAP) siRNA
aacctgggaggcggaggttgcag

SEQ ID NO: 17938 - DNA, 23 bp, Artificial Sequence
  X-linked inhibitor of apoptosis (XIAP) siRNA
acctgggaggcggaggttgcagg

SEQ ID NO: 17939 - DNA, 23 bp, Artificial Sequence
  X-linked inhibitor of apoptosis (XIAP) siRNA
cctgggaggcggaggttgcaggg

SEQ ID NO: 17940 - DNA, 23 bp, Artificial Sequence
  X-linked inhibitor of apoptosis (XIAP) siRNA
ctgggaggcggaggttgcaggga

SEQ ID NO: 17941 - DNA, 23 bp, Artificial Sequence
  X-linked inhibitor of apoptosis (XIAP) siRNA
tgggaggcggaggttgcagggag

SEQ ID NO: 17942 - DNA, 23 bp, Artificial Sequence
  X-linked inhibitor of apoptosis (XIAP) siRNA
gggaggcggaggttgcagggagc

SEQ ID NO: 17943 - DNA, 23 bp, Artificial Sequence
  X-linked inhibitor of apoptosis (XIAP) siRNA
ggaggcggaggttgcagggagcc

SEQ ID NO: 17944 - DNA, 23 bp, Artificial Sequence
  X-linked inhibitor of apoptosis (XIAP) siRNA
gaggcggaggttgcagggagcca

SEQ ID NO: 17945 - DNA, 23 bp, Artificial Sequence
  X-linked inhibitor of apoptosis (XIAP) siRNA
aggcggaggttgcagggagccaa

SEQ ID NO: 17946 - DNA, 23 bp, Artificial Sequence
  X-linked inhibitor of apoptosis (XIAP) siRNA
ggcggaggttgcagggagccaag

SEQ ID NO: 17947 - DNA, 23 bp, Artificial Sequence
  X-linked inhibitor of apoptosis (XIAP) siRNA
gcggaggttgcagggagccaaga

SEQ ID NO: 17948 - DNA, 23 bp, Artificial Sequence
  X-linked inhibitor of apoptosis (XIAP) siRNA
cggaggttgcagggagccaagat

SEQ ID NO: 17949 - DNA, 23 bp, Artificial Sequence
  X-linked inhibitor of apoptosis (XIAP) siRNA
ggaggttgcagggagccaagatg

SEQ ID NO: 17950 - DNA, 23 bp, Artificial Sequence
  X-linked inhibitor of apoptosis (XIAP) siRNA
gaggttgcagggagccaagatgg

SEQ ID NO: 17951 - DNA, 23 bp, Artificial Sequence
  X-linked inhibitor of apoptosis (XIAP) siRNA
aggttgcagggagccaagatggc

SEQ ID NO: 17952 - DNA, 23 bp, Artificial Sequence
  X-linked inhibitor of apoptosis (XIAP) siRNA
ggttgcagggagccaagatggcg

SEQ ID NO: 17953 - DNA, 23 bp, Artificial Sequence
  X-linked inhibitor of apoptosis (XIAP) siRNA
gttgcagggagccaagatggcgc

SEQ ID NO: 17954 - DNA, 23 bp, Artificial Sequence
  X-linked inhibitor of apoptosis (XIAP) siRNA
ttgcagggagccaagatggcgcc

SEQ ID NO: 17955 - DNA, 23 bp, Artificial Sequence
  X-linked inhibitor of apoptosis (XIAP) siRNA
tgcagggagccaagatggcgcca

SEQ ID NO: 17956 - DNA, 23 bp, Artificial Sequence
  X-linked inhibitor of apoptosis (XIAP) siRNA
gcagggagccaagatggcgccac

SEQ ID NO: 17957 - DNA, 23 bp, Artificial Sequence
  X-linked inhibitor of apoptosis (XIAP) siRNA
cagggagccaagatggcgccacc

SEQ ID NO: 17958 - DNA, 23 bp, Artificial Sequence
  X-linked inhibitor of apoptosis (XIAP) siRNA
agggagccaagatggcgccaccg

SEQ ID NO: 17959 - DNA, 23 bp, Artificial Sequence
  X-linked inhibitor of apoptosis (XIAP) siRNA
gggagccaagatggcgccaccgc

SEQ ID NO: 17960 - DNA, 23 bp, Artificial Sequence
  X-linked inhibitor of apoptosis (XIAP) siRNA
ggagccaagatggcgccaccgca

SEQ ID NO: 17961 - DNA, 23 bp, Artificial Sequence
  X-linked inhibitor of apoptosis (XIAP) siRNA
gagccaagatggcgccaccgcac

SEQ ID NO: 17962 - DNA, 23 bp, Artificial Sequence
  X-linked inhibitor of apoptosis (XIAP) siRNA
agccaagatggcgccaccgcact

SEQ ID NO: 17963 - DNA, 23 bp, Artificial Sequence
  X-linked inhibitor of apoptosis (XIAP) siRNA
gccaagatggcgccaccgcactc

SEQ ID NO: 17964 - DNA, 23 bp, Artificial Sequence
  X-linked inhibitor of apoptosis (XIAP) siRNA
ccaagatggcgccaccgcactcc

SEQ ID NO: 17965 - DNA, 23 bp, Artificial Sequence
  X-linked inhibitor of apoptosis (XIAP) siRNA
caagatggcgccaccgcactcca

SEQ ID NO: 17966 - DNA, 23 bp, Artificial Sequence
  X-linked inhibitor of apoptosis (XIAP) siRNA
aagatggcgccaccgcactccag

SEQ ID NO: 17967 - DNA, 23 bp, Artificial Sequence
  X-linked inhibitor of apoptosis (XIAP) siRNA
agatggcgccaccgcactccagc

SEQ ID NO: 17968 - DNA, 23 bp, Artificial Sequence
  X-linked inhibitor of apoptosis (XIAP) siRNA
gatggcgccaccgcactccagcc

SEQ ID NO: 17969 - DNA, 23 bp, Artificial Sequence
  X-linked inhibitor of apoptosis (XIAP) siRNA
atggcgccaccgcactccagcct

SEQ ID NO: 17970 - DNA, 23 bp, Artificial Sequence
  X-linked inhibitor of apoptosis (XIAP) siRNA
tggcgccaccgcactccagccta

SEQ ID NO: 17971 - DNA, 23 bp, Artificial Sequence
  X-linked inhibitor of apoptosis (XIAP) siRNA
ggcgccaccgcactccagcctag

SEQ ID NO: 17972 - DNA, 23 bp, Artificial Sequence
  X-linked inhibitor of apoptosis (XIAP) siRNA
gcgccaccgcactccagcctagg

SEQ ID NO: 17973 - DNA, 23 bp, Artificial Sequence
  X-linked inhibitor of apoptosis (XIAP) siRNA
cgccaccgcactccagcctaggt

SEQ ID NO: 17974 - DNA, 23 bp, Artificial Sequence
  X-linked inhibitor of apoptosis (XIAP) siRNA
gccaccgcactccagcctaggtg

SEQ ID NO: 17975 - DNA, 23 bp, Artificial Sequence
  X-linked inhibitor of apoptosis (XIAP) siRNA
ccaccgcactccagcctaggtga

SEQ ID NO: 17976 - DNA, 23 bp, Artificial Sequence
  X-linked inhibitor of apoptosis (XIAP) siRNA
caccgcactccagcctaggtgat

SEQ ID NO: 17977 - DNA, 23 bp, Artificial Sequence
  X-linked inhibitor of apoptosis (XIAP) siRNA
accgcactccagcctaggtgata

SEQ ID NO: 17978 - DNA, 23 bp, Artificial Sequence
  X-linked inhibitor of apoptosis (XIAP) siRNA
ccgcactccagcctaggtgatag

SEQ ID NO: 17979 - DNA, 23 bp, Artificial Sequence
  X-linked inhibitor of apoptosis (XIAP) siRNA
cgcactccagcctaggtgataga

SEQ ID NO: 17980 - DNA, 23 bp, Artificial Sequence
  X-linked inhibitor of apoptosis (XIAP) siRNA
gcactccagcctaggtgatagag

SEQ ID NO: 17981 - DNA, 23 bp, Artificial Sequence
  X-linked inhibitor of apoptosis (XIAP) siRNA
cactccagcctaggtgatagagt

SEQ ID NO: 17982 - DNA, 23 bp, Artificial Sequence
  X-linked inhibitor of apoptosis (XIAP) siRNA
actccagcctaggtgatagagtg

SEQ ID NO: 17983 - DNA, 23 bp, Artificial Sequence
  X-linked inhibitor of apoptosis (XIAP) siRNA
ctccagcctaggtgatagagtga

SEQ ID NO: 17984 - DNA, 23 bp, Artificial Sequence
  X-linked inhibitor of apoptosis (XIAP) siRNA
tccagcctaggtgatagagtgag

SEQ ID NO: 17985 - DNA, 23 bp, Artificial Sequence
  X-linked inhibitor of apoptosis (XIAP) siRNA
ccagcctaggtgatagagtgaga

SEQ ID NO: 17986 - DNA, 23 bp, Artificial Sequence
  X-linked inhibitor of apoptosis (XIAP) siRNA
cagcctaggtgatagagtgagac

SEQ ID NO: 17987 - DNA, 23 bp, Artificial Sequence
  X-linked inhibitor of apoptosis (XIAP) siRNA
agcctaggtgatagagtgagact

SEQ ID NO: 17988 - DNA, 23 bp, Artificial Sequence
  X-linked inhibitor of apoptosis (XIAP) siRNA
gcctaggtgatagagtgagactc

SEQ ID NO: 17989 - DNA, 23 bp, Artificial Sequence
  X-linked inhibitor of apoptosis (XIAP) siRNA
cctaggtgatagagtgagactcc

SEQ ID NO: 17990 - DNA, 23 bp, Artificial Sequence
  X-linked inhibitor of apoptosis (XIAP) siRNA
ctaggtgatagagtgagactccc

SEQ ID NO: 17991 - DNA, 23 bp, Artificial Sequence
  X-linked inhibitor of apoptosis (XIAP) siRNA
taggtgatagagtgagactccct

SEQ ID NO: 17992 - DNA, 23 bp, Artificial Sequence
  X-linked inhibitor of apoptosis (XIAP) siRNA
aggtgatagagtgagactccctc

SEQ ID NO: 17993 - DNA, 23 bp, Artificial Sequence
  X-linked inhibitor of apoptosis (XIAP) siRNA
ggtgatagagtgagactccctct

SEQ ID NO: 17994 - DNA, 23 bp, Artificial Sequence
  X-linked inhibitor of apoptosis (XIAP) siRNA
gtgatagagtgagactccctctc

SEQ ID NO: 17995 - DNA, 23 bp, Artificial Sequence
  X-linked inhibitor of apoptosis (XIAP) siRNA
tgatagagtgagactccctctca

SEQ ID NO: 17996 - DNA, 23 bp, Artificial Sequence
  X-linked inhibitor of apoptosis (XIAP) siRNA
gatagagtgagactccctctcaa

SEQ ID NO: 17997 - DNA, 23 bp, Artificial Sequence
  X-linked inhibitor of apoptosis (XIAP) siRNA
atagagtgagactccctctcaaa

SEQ ID NO: 17998 - DNA, 23 bp, Artificial Sequence
  X-linked inhibitor of apoptosis (XIAP) siRNA
tagagtgagactccctctcaaaa

SEQ ID NO: 17999 - DNA, 23 bp, Artificial Sequence
  X-linked inhibitor of apoptosis (XIAP) siRNA
agagtgagactccctctcaaaaa

SEQ ID NO: 18000 - DNA, 23 bp, Artificial Sequence
  X-linked inhibitor of apoptosis (XIAP) siRNA
gagtgagactccctctcaaaaac

SEQ ID NO: 18001 - DNA, 23 bp, Artificial Sequence
  X-linked inhibitor of apoptosis (XIAP) siRNA
agtgagactccctctcaaaaaca

SEQ ID NO: 18002 - DNA, 23 bp, Artificial Sequence
  X-linked inhibitor of apoptosis (XIAP) siRNA
gtgagactccctctcaaaaacaa

SEQ ID NO: 18003 - DNA, 23 bp, Artificial Sequence
  X-linked inhibitor of apoptosis (XIAP) siRNA
tgagactccctctcaaaaacaaa

SEQ ID NO: 18004 - DNA, 23 bp, Artificial Sequence
  X-linked inhibitor of apoptosis (XIAP) siRNA
gagactccctctcaaaaacaaaa

SEQ ID NO: 18005 - DNA, 23 bp, Artificial Sequence
  X-linked inhibitor of apoptosis (XIAP) siRNA
agactccctctcaaaaacaaaac

SEQ ID NO: 18006 - DNA, 23 bp, Artificial Sequence
  X-linked inhibitor of apoptosis (XIAP) siRNA
gactccctctcaaaaacaaaaca

SEQ ID NO: 18007 - DNA, 23 bp, Artificial Sequence
  X-linked inhibitor of apoptosis (XIAP) siRNA
actccctctcaaaaacaaaacaa

SEQ ID NO: 18008 - DNA, 23 bp, Artificial Sequence
  X-linked inhibitor of apoptosis (XIAP) siRNA
ctccctctcaaaaacaaaacaaa

SEQ ID NO: 18009 - DNA, 23 bp, Artificial Sequence
  X-linked inhibitor of apoptosis (XIAP) siRNA
tccctctcaaaaacaaaacaaaa

SEQ ID NO: 18010 - DNA, 23 bp, Artificial Sequence
  X-linked inhibitor of apoptosis (XIAP) siRNA
ccctctcaaaaacaaaacaaaac

SEQ ID NO: 18011 - DNA, 23 bp, Artificial Sequence
  X-linked inhibitor of apoptosis (XIAP) siRNA
cctctcaaaaacaaaacaaaaca

SEQ ID NO: 18012 - DNA, 23 bp, Artificial Sequence
  X-linked inhibitor of apoptosis (XIAP) siRNA
ctctcaaaaacaaaacaaaacaa

SEQ ID NO: 18013 - DNA, 23 bp, Artificial Sequence
  X-linked inhibitor of apoptosis (XIAP) siRNA
tctcaaaaacaaaacaaaacaaa

SEQ ID NO: 18014 - DNA, 23 bp, Artificial Sequence
  X-linked inhibitor of apoptosis (XIAP) siRNA
ctcaaaaacaaaacaaaacaaaa

SEQ ID NO: 18015 - DNA, 23 bp, Artificial Sequence
  X-linked inhibitor of apoptosis (XIAP) siRNA
tcaaaaacaaaacaaaacaaaaa

SEQ ID NO: 18016 - DNA, 23 bp, Artificial Sequence
  X-linked inhibitor of apoptosis (XIAP) siRNA
caaaaacaaaacaaaacaaaaaa

SEQ ID NO: 18017 - DNA, 23 bp, Artificial Sequence
  X-linked inhibitor of apoptosis (XIAP) siRNA
aaaaacaaaacaaaacaaaaaaa

SEQ ID NO: 18018 - DNA, 23 bp, Artificial Sequence
  X-linked inhibitor of apoptosis (XIAP) siRNA
aaaacaaaacaaaacaaaaaaat

SEQ ID NO: 18019 - DNA, 23 bp, Artificial Sequence
  X-linked inhibitor of apoptosis (XIAP) siRNA
aaacaaaacaaaacaaaaaaatt

SEQ ID NO: 18020 - DNA, 23 bp, Artificial Sequence
  X-linked inhibitor of apoptosis (XIAP) siRNA
aacaaaacaaaacaaaaaaatta

SEQ ID NO: 18021 - DNA, 23 bp, Artificial Sequence
  X-linked inhibitor of apoptosis (XIAP) siRNA
acaaaacaaaacaaaaaaattag

SEQ ID NO: 18022 - DNA, 23 bp, Artificial Sequence
  X-linked inhibitor of apoptosis (XIAP) siRNA
caaaacaaaacaaaaaaattaga

SEQ ID NO: 18023 - DNA, 23 bp, Artificial Sequence
  X-linked inhibitor of apoptosis (XIAP) siRNA
aaaacaaaacaaaaaaattagac

SEQ ID NO: 18024 - DNA, 23 bp, Artificial Sequence
  X-linked inhibitor of apoptosis (XIAP) siRNA
aaacaaaacaaaaaaattagaca

SEQ ID NO: 18025 - DNA, 23 bp, Artificial Sequence
  X-linked inhibitor of apoptosis (XIAP) siRNA
aacaaaacaaaaaaattagacaa

SEQ ID NO: 18026 - DNA, 23 bp, Artificial Sequence
  X-linked inhibitor of apoptosis (XIAP) siRNA
acaaaacaaaaaaattagacaaa

SEQ ID NO: 18027 - DNA, 23 bp, Artificial Sequence
  X-linked inhibitor of apoptosis (XIAP) siRNA
caaaacaaaaaaattagacaaat

SEQ ID NO: 18028 - DNA, 23 bp, Artificial Sequence
  X-linked inhibitor of apoptosis (XIAP) siRNA
aaaacaaaaaaattagacaaatg

SEQ ID NO: 18029 - DNA, 23 bp, Artificial Sequence
  X-linked inhibitor of apoptosis (XIAP) siRNA
aaacaaaaaaattagacaaatgc

SEQ ID NO: 18030 - DNA, 23 bp, Artificial Sequence
  X-linked inhibitor of apoptosis (XIAP) siRNA
aacaaaaaaattagacaaatgct

SEQ ID NO: 18031 - DNA, 23 bp, Artificial Sequence
  X-linked inhibitor of apoptosis (XIAP) siRNA
acaaaaaaattagacaaatgcta

SEQ ID NO: 18032 - DNA, 23 bp, Artificial Sequence
  X-linked inhibitor of apoptosis (XIAP) siRNA
caaaaaaattagacaaatgctac

SEQ ID NO: 18033 - DNA, 23 bp, Artificial Sequence
  X-linked inhibitor of apoptosis (XIAP) siRNA
aaaaaaattagacaaatgctaca

SEQ ID NO: 18034 - DNA, 23 bp, Artificial Sequence
  X-linked inhibitor of apoptosis (XIAP) siRNA
aaaaaattagacaaatgctacat

SEQ ID NO: 18035 - DNA, 23 bp, Artificial Sequence
  X-linked inhibitor of apoptosis (XIAP) siRNA
aaaaattagacaaatgctacatt

SEQ ID NO: 18036 - DNA, 23 bp, Artificial Sequence
  X-linked inhibitor of apoptosis (XIAP) siRNA
aaaattagacaaatgctacatta

SEQ ID NO: 18037 - DNA, 23 bp, Artificial Sequence
  X-linked inhibitor of apoptosis (XIAP) siRNA
aaattagacaaatgctacattaa

SEQ ID NO: 18038 - DNA, 23 bp, Artificial Sequence
  X-linked inhibitor of apoptosis (XIAP) siRNA
aattagacaaatgctacattaat

SEQ ID NO: 18039 - DNA, 23 bp, Artificial Sequence
  X-linked inhibitor of apoptosis (XIAP) siRNA
attagacaaatgctacattaatg

SEQ ID NO: 18040 - DNA, 23 bp, Artificial Sequence
  X-linked inhibitor of apoptosis (XIAP) siRNA
ttagacaaatgctacattaatgt

SEQ ID NO: 18041 - DNA, 23 bp, Artificial Sequence
  X-linked inhibitor of apoptosis (XIAP) siRNA
tagacaaatgctacattaatgtt

SEQ ID NO: 18042 - DNA, 23 bp, Artificial Sequence
  X-linked inhibitor of apoptosis (XIAP) siRNA
agacaaatgctacattaatgttt

SEQ ID NO: 18043 - DNA, 23 bp, Artificial Sequence
  X-linked inhibitor of apoptosis (XIAP) siRNA
gacaaatgctacattaatgtttg

SEQ ID NO: 18044 - DNA, 23 bp, Artificial Sequence
  X-linked inhibitor of apoptosis (XIAP) siRNA
acaaatgctacattaatgtttgg

SEQ ID NO: 18045 - DNA, 23 bp, Artificial Sequence
  X-linked inhibitor of apoptosis (XIAP) siRNA
caaatgctacattaatgtttggg

SEQ ID NO: 18046 - DNA, 23 bp, Artificial Sequence
  X-linked inhibitor of apoptosis (XIAP) siRNA
aaatgctacattaatgtttgggt

SEQ ID NO: 18047 - DNA, 23 bp, Artificial Sequence
  X-linked inhibitor of apoptosis (XIAP) siRNA
aatgctacattaatgtttgggtg

SEQ ID NO: 18048 - DNA, 23 bp, Artificial Sequence
  X-linked inhibitor of apoptosis (XIAP) siRNA
atgctacattaatgtttgggtgg

SEQ ID NO: 18049 - DNA, 23 bp, Artificial Sequence
  X-linked inhibitor of apoptosis (XIAP) siRNA
tgctacattaatgtttgggtggt

SEQ ID NO: 18050 - DNA, 23 bp, Artificial Sequence
  X-linked inhibitor of apoptosis (XIAP) siRNA
gctacattaatgtttgggtggtc

SEQ ID NO: 18051 - DNA, 23 bp, Artificial Sequence
  X-linked inhibitor of apoptosis (XIAP) siRNA
ctacattaatgtttgggtggtca

SEQ ID NO: 18052 - DNA, 23 bp, Artificial Sequence
  X-linked inhibitor of apoptosis (XIAP) siRNA
tacattaatgtttgggtggtcag

SEQ ID NO: 18053 - DNA, 23 bp, Artificial Sequence
  X-linked inhibitor of apoptosis (XIAP) siRNA
acattaatgtttgggtggtcaga

SEQ ID NO: 18054 - DNA, 23 bp, Artificial Sequence
  X-linked inhibitor of apoptosis (XIAP) siRNA
cattaatgtttgggtggtcagat

SEQ ID NO: 18055 - DNA, 23 bp, Artificial Sequence
  X-linked inhibitor of apoptosis (XIAP) siRNA
attaatgtttgggtggtcagatt

SEQ ID NO: 18056 - DNA, 23 bp, Artificial Sequence
  X-linked inhibitor of apoptosis (XIAP) siRNA
ttaatgtttgggtggtcagattc

SEQ ID NO: 18057 - DNA, 23 bp, Artificial Sequence
  X-linked inhibitor of apoptosis (XIAP) siRNA
taatgtttgggtggtcagattct

SEQ ID NO: 18058 - DNA, 23 bp, Artificial Sequence
  X-linked inhibitor of apoptosis (XIAP) siRNA
aatgtttgggtggtcagattcta

SEQ ID NO: 18059 - DNA, 23 bp, Artificial Sequence
  X-linked inhibitor of apoptosis (XIAP) siRNA
atgtttgggtggtcagattctac

SEQ ID NO: 18060 - DNA, 23 bp, Artificial Sequence
  X-linked inhibitor of apoptosis (XIAP) siRNA
tgtttgggtggtcagattctact

SEQ ID NO: 18061 - DNA, 23 bp, Artificial Sequence
  X-linked inhibitor of apoptosis (XIAP) siRNA
gtttgggtggtcagattctactt

SEQ ID NO: 18062 - DNA, 23 bp, Artificial Sequence
  X-linked inhibitor of apoptosis (XIAP) siRNA
tttgggtggtcagattctacttt

SEQ ID NO: 18063 - DNA, 23 bp, Artificial Sequence
  X-linked inhibitor of apoptosis (XIAP) siRNA
ttgggtggtcagattctactttg

SEQ ID NO: 18064 - DNA, 23 bp, Artificial Sequence
  X-linked inhibitor of apoptosis (XIAP) siRNA
tgggtggtcagattctactttga

SEQ ID NO: 18065 - DNA, 23 bp, Artificial Sequence
  X-linked inhibitor of apoptosis (XIAP) siRNA
gggtggtcagattctactttgaa

SEQ ID NO: 18066 - DNA, 23 bp, Artificial Sequence
  X-linked inhibitor of apoptosis (XIAP) siRNA
ggtggtcagattctactttgaat

SEQ ID NO: 18067 - DNA, 23 bp, Artificial Sequence
  X-linked inhibitor of apoptosis (XIAP) siRNA
gtggtcagattctactttgaatc

SEQ ID NO: 18068 - DNA, 23 bp, Artificial Sequence
  X-linked inhibitor of apoptosis (XIAP) siRNA
tggtcagattctactttgaatct

SEQ ID NO: 18069 - DNA, 23 bp, Artificial Sequence
  X-linked inhibitor of apoptosis (XIAP) siRNA
ggtcagattctactttgaatctg

SEQ ID NO: 18070 - DNA, 23 bp, Artificial Sequence
  X-linked inhibitor of apoptosis (XIAP) siRNA
gtcagattctactttgaatctga

SEQ ID NO: 18071 - DNA, 23 bp, Artificial Sequence
  X-linked inhibitor of apoptosis (XIAP) siRNA
tcagattctactttgaatctgaa

SEQ ID NO: 18072 - DNA, 23 bp, Artificial Sequence
  X-linked inhibitor of apoptosis (XIAP) siRNA
cagattctactttgaatctgaag

SEQ ID NO: 18073 - DNA, 23 bp, Artificial Sequence
  X-linked inhibitor of apoptosis (XIAP) siRNA
agattctactttgaatctgaagt

SEQ ID NO: 18074 - DNA, 23 bp, Artificial Sequence
  X-linked inhibitor of apoptosis (XIAP) siRNA
gattctactttgaatctgaagtt

SEQ ID NO: 18075 - DNA, 23 bp, Artificial Sequence
  X-linked inhibitor of apoptosis (XIAP) siRNA
attctactttgaatctgaagttt

SEQ ID NO: 18076 - DNA, 23 bp, Artificial Sequence
  X-linked inhibitor of apoptosis (XIAP) siRNA
ttctactttgaatctgaagtttg

SEQ ID NO: 18077 - DNA, 23 bp, Artificial Sequence
  X-linked inhibitor of apoptosis (XIAP) siRNA
tctactttgaatctgaagtttgc

SEQ ID NO: 18078 - DNA, 23 bp, Artificial Sequence
  X-linked inhibitor of apoptosis (XIAP) siRNA
ctactttgaatctgaagtttgca

SEQ ID NO: 18079 - DNA, 23 bp, Artificial Sequence
  X-linked inhibitor of apoptosis (XIAP) siRNA
tactttgaatctgaagtttgcag

SEQ ID NO: 18080 - DNA, 23 bp, Artificial Sequence
  X-linked inhibitor of apoptosis (XIAP) siRNA
actttgaatctgaagtttgcaga

SEQ ID NO: 18081 - DNA, 23 bp, Artificial Sequence
  X-linked inhibitor of apoptosis (XIAP) siRNA
ctttgaatctgaagtttgcagat

SEQ ID NO: 18082 - DNA, 23 bp, Artificial Sequence
  X-linked inhibitor of apoptosis (XIAP) siRNA
tttgaatctgaagtttgcagata

SEQ ID NO: 18083 - DNA, 23 bp, Artificial Sequence
  X-linked inhibitor of apoptosis (XIAP) siRNA
ttgaatctgaagtttgcagatat

SEQ ID NO: 18084 - DNA, 23 bp, Artificial Sequence
  X-linked inhibitor of apoptosis (XIAP) siRNA
tgaatctgaagtttgcagatatg

SEQ ID NO: 18085 - DNA, 23 bp, Artificial Sequence
  X-linked inhibitor of apoptosis (XIAP) siRNA
gaatctgaagtttgcagatatgc

SEQ ID NO: 18086 - DNA, 23 bp, Artificial Sequence
  X-linked inhibitor of apoptosis (XIAP) siRNA
aatctgaagtttgcagatatgcc

SEQ ID NO: 18087 - DNA, 23 bp, Artificial Sequence
  X-linked inhibitor of apoptosis (XIAP) siRNA
atctgaagtttgcagatatgcct

SEQ ID NO: 18088 - DNA, 23 bp, Artificial Sequence
  X-linked inhibitor of apoptosis (XIAP) siRNA
tctgaagtttgcagatatgccta

SEQ ID NO: 18089 - DNA, 23 bp, Artificial Sequence
  X-linked inhibitor of apoptosis (XIAP) siRNA
ctgaagtttgcagatatgcctat

SEQ ID NO: 18090 - DNA, 23 bp, Artificial Sequence
  X-linked inhibitor of apoptosis (XIAP) siRNA
tgaagtttgcagatatgcctata

SEQ ID NO: 18091 - DNA, 23 bp, Artificial Sequence
  X-linked inhibitor of apoptosis (XIAP) siRNA
gaagtttgcagatatgcctatag

SEQ ID NO: 18092 - DNA, 23 bp, Artificial Sequence
  X-linked inhibitor of apoptosis (XIAP) siRNA
aagtttgcagatatgcctataga

SEQ ID NO: 18093 - DNA, 23 bp, Artificial Sequence
  X-linked inhibitor of apoptosis (XIAP) siRNA
agtttgcagatatgcctatagat

SEQ ID NO: 18094 - DNA, 23 bp, Artificial Sequence
  X-linked inhibitor of apoptosis (XIAP) siRNA
gtttgcagatatgcctatagatt

SEQ ID NO: 18095 - DNA, 23 bp, Artificial Sequence
  X-linked inhibitor of apoptosis (XIAP) siRNA
tttgcagatatgcctatagattt

SEQ ID NO: 18096 - DNA, 23 bp, Artificial Sequence
  X-linked inhibitor of apoptosis (XIAP) siRNA
ttgcagatatgcctatagatttt

SEQ ID NO: 18097 - DNA, 23 bp, Artificial Sequence
  X-linked inhibitor of apoptosis (XIAP) siRNA
tgcagatatgcctatagattttt

SEQ ID NO: 18098 - DNA, 23 bp, Artificial Sequence
  X-linked inhibitor of apoptosis (XIAP) siRNA
gcagatatgcctatagatttttg

SEQ ID NO: 18099 - DNA, 23 bp, Artificial Sequence
  X-linked inhibitor of apoptosis (XIAP) siRNA
cagatatgcctatagatttttgg

SEQ ID NO: 18100 - DNA, 23 bp, Artificial Sequence
  X-linked inhibitor of apoptosis (XIAP) siRNA
agatatgcctatagatttttgga

SEQ ID NO: 18101 - DNA, 23 bp, Artificial Sequence
  X-linked inhibitor of apoptosis (XIAP) siRNA
gatatgcctatagatttttggag

SEQ ID NO: 18102 - DNA, 23 bp, Artificial Sequence
  X-linked inhibitor of apoptosis (XIAP) siRNA
atatgcctatagatttttggagt

SEQ ID NO: 18103 - DNA, 23 bp, Artificial Sequence
  X-linked inhibitor of apoptosis (XIAP) siRNA
tatgcctatagatttttggagtt

SEQ ID NO: 18104 - DNA, 23 bp, Artificial Sequence
  X-linked inhibitor of apoptosis (XIAP) siRNA
atgcctatagatttttggagttt

SEQ ID NO: 18105 - DNA, 23 bp, Artificial Sequence
  X-linked inhibitor of apoptosis (XIAP) siRNA
tgcctatagatttttggagttta

SEQ ID NO: 18106 - DNA, 23 bp, Artificial Sequence
  X-linked inhibitor of apoptosis (XIAP) siRNA
gcctatagatttttggagtttac

SEQ ID NO: 18107 - DNA, 23 bp, Artificial Sequence
  X-linked inhibitor of apoptosis (XIAP) siRNA
cctatagatttttggagtttacc

SEQ ID NO: 18108 - DNA, 23 bp, Artificial Sequence
  X-linked inhibitor of apoptosis (XIAP) siRNA
ctatagatttttggagtttacca

SEQ ID NO: 18109 - DNA, 23 bp, Artificial Sequence
  X-linked inhibitor of apoptosis (XIAP) siRNA
tatagatttttggagtttaccac

SEQ ID NO: 18110 - DNA, 23 bp, Artificial Sequence
  X-linked inhibitor of apoptosis (XIAP) siRNA
atagatttttggagtttaccact

SEQ ID NO: 18111 - DNA, 23 bp, Artificial Sequence
  X-linked inhibitor of apoptosis (XIAP) siRNA
tagatttttggagtttaccactt

SEQ ID NO: 18112 - DNA, 23 bp, Artificial Sequence
  X-linked inhibitor of apoptosis (XIAP) siRNA
agatttttggagtttaccacttt

SEQ ID NO: 18113 - DNA, 23 bp, Artificial Sequence
  X-linked inhibitor of apoptosis (XIAP) siRNA
gatttttggagtttaccactttc

SEQ ID NO: 18114 - DNA, 23 bp, Artificial Sequence
  X-linked inhibitor of apoptosis (XIAP) siRNA
atttttggagtttaccactttct

SEQ ID NO: 18115 - DNA, 23 bp, Artificial Sequence
  X-linked inhibitor of apoptosis (XIAP) siRNA
tttttggagtttaccactttctt

SEQ ID NO: 18116 - DNA, 23 bp, Artificial Sequence
  X-linked inhibitor of apoptosis (XIAP) siRNA
ttttggagtttaccactttctta

SEQ ID NO: 18117 - DNA, 23 bp, Artificial Sequence
  X-linked inhibitor of apoptosis (XIAP) siRNA
tttggagtttaccactttcttat

SEQ ID NO: 18118 - DNA, 23 bp, Artificial Sequence
  X-linked inhibitor of apoptosis (XIAP) siRNA
ttggagtttaccactttcttatt

SEQ ID NO: 18119 - DNA, 23 bp, Artificial Sequence
  X-linked inhibitor of apoptosis (XIAP) siRNA
tggagtttaccactttcttattc

SEQ ID NO: 18120 - DNA, 23 bp, Artificial Sequence
  X-linked inhibitor of apoptosis (XIAP) siRNA
ggagtttaccactttcttattct

SEQ ID NO: 18121 - DNA, 23 bp, Artificial Sequence
  X-linked inhibitor of apoptosis (XIAP) siRNA
gagtttaccactttcttattctg

SEQ ID NO: 18122 - DNA, 23 bp, Artificial Sequence
  X-linked inhibitor of apoptosis (XIAP) siRNA
agtttaccactttcttattctgt

SEQ ID NO: 18123 - DNA, 23 bp, Artificial Sequence
  X-linked inhibitor of apoptosis (XIAP) siRNA
gtttaccactttcttattctgta

SEQ ID NO: 18124 - DNA, 23 bp, Artificial Sequence
  X-linked inhibitor of apoptosis (XIAP) siRNA
tttaccactttcttattctgtat

SEQ ID NO: 18125 - DNA, 23 bp, Artificial Sequence
  X-linked inhibitor of apoptosis (XIAP) siRNA
ttaccactttcttattctgtatc

SEQ ID NO: 18126 - DNA, 23 bp, Artificial Sequence
  X-linked inhibitor of apoptosis (XIAP) siRNA
taccactttcttattctgtatca

SEQ ID NO: 18127 - DNA, 23 bp, Artificial Sequence
  X-linked inhibitor of apoptosis (XIAP) siRNA
accactttcttattctgtatcat

SEQ ID NO: 18128 - DNA, 23 bp, Artificial Sequence
  X-linked inhibitor of apoptosis (XIAP) siRNA
ccactttcttattctgtatcatt

SEQ ID NO: 18129 - DNA, 23 bp, Artificial Sequence
  X-linked inhibitor of apoptosis (XIAP) siRNA
cactttcttattctgtatcatta

SEQ ID NO: 18130 - DNA, 23 bp, Artificial Sequence
  X-linked inhibitor of apoptosis (XIAP) siRNA
actttcttattctgtatcattaa

SEQ ID NO: 18131 - DNA, 23 bp, Artificial Sequence
  X-linked inhibitor of apoptosis (XIAP) siRNA
ctttcttattctgtatcattaat

SEQ ID NO: 18132 - DNA, 23 bp, Artificial Sequence
  X-linked inhibitor of apoptosis (XIAP) siRNA
tttcttattctgtatcattaatg

SEQ ID NO: 18133 - DNA, 23 bp, Artificial Sequence
  X-linked inhibitor of apoptosis (XIAP) siRNA
ttcttattctgtatcattaatgt

SEQ ID NO: 18134 - DNA, 23 bp, Artificial Sequence
  X-linked inhibitor of apoptosis (XIAP) siRNA
tcttattctgtatcattaatgta

SEQ ID NO: 18135 - DNA, 23 bp, Artificial Sequence
  X-linked inhibitor of apoptosis (XIAP) siRNA
cttattctgtatcattaatgtaa

SEQ ID NO: 18136 - DNA, 23 bp, Artificial Sequence
  X-linked inhibitor of apoptosis (XIAP) siRNA
ttattctgtatcattaatgtaat

SEQ ID NO: 18137 - DNA, 23 bp, Artificial Sequence
  X-linked inhibitor of apoptosis (XIAP) siRNA
tattctgtatcattaatgtaata

SEQ ID NO: 18138 - DNA, 23 bp, Artificial Sequence
  X-linked inhibitor of apoptosis (XIAP) siRNA
attctgtatcattaatgtaatat

SEQ ID NO: 18139 - DNA, 23 bp, Artificial Sequence
  X-linked inhibitor of apoptosis (XIAP) siRNA
ttctgtatcattaatgtaatatt

SEQ ID NO: 18140 - DNA, 23 bp, Artificial Sequence
  X-linked inhibitor of apoptosis (XIAP) siRNA
tctgtatcattaatgtaatattt

SEQ ID NO: 18141 - DNA, 23 bp, Artificial Sequence
  X-linked inhibitor of apoptosis (XIAP) siRNA
ctgtatcattaatgtaatatttt

SEQ ID NO: 18142 - DNA, 23 bp, Artificial Sequence
  X-linked inhibitor of apoptosis (XIAP) siRNA
tgtatcattaatgtaatatttta

SEQ ID NO: 18143 - DNA, 23 bp, Artificial Sequence
  X-linked inhibitor of apoptosis (XIAP) siRNA
gtatcattaatgtaatattttaa

SEQ ID NO: 18144 - DNA, 23 bp, Artificial Sequence
  X-linked inhibitor of apoptosis (XIAP) siRNA
tatcattaatgtaatattttaaa

SEQ ID NO: 18145 - DNA, 23 bp, Artificial Sequence
  X-linked inhibitor of apoptosis (XIAP) siRNA
atcattaatgtaatattttaaat

SEQ ID NO: 18146 - DNA, 23 bp, Artificial Sequence
  X-linked inhibitor of apoptosis (XIAP) siRNA
tcattaatgtaatattttaaatt

SEQ ID NO: 18147 - DNA, 23 bp, Artificial Sequence
  X-linked inhibitor of apoptosis (XIAP) siRNA
cattaatgtaatattttaaatta

SEQ ID NO: 18148 - DNA, 23 bp, Artificial Sequence
  X-linked inhibitor of apoptosis (XIAP) siRNA
attaatgtaatattttaaattac

SEQ ID NO: 18149 - DNA, 23 bp, Artificial Sequence
  X-linked inhibitor of apoptosis (XIAP) siRNA
ttaatgtaatattttaaattact

SEQ ID NO: 18150 - DNA, 23 bp, Artificial Sequence
  X-linked inhibitor of apoptosis (XIAP) siRNA
taatgtaatattttaaattacta

SEQ ID NO: 18151 - DNA, 23 bp, Artificial Sequence
  X-linked inhibitor of apoptosis (XIAP) siRNA
aatgtaatattttaaattactat

SEQ ID NO: 18152 - DNA, 23 bp, Artificial Sequence
  X-linked inhibitor of apoptosis (XIAP) siRNA
atgtaatattttaaattactata

SEQ ID NO: 18153 - DNA, 23 bp, Artificial Sequence
  X-linked inhibitor of apoptosis (XIAP) siRNA
tgtaatattttaaattactatat

SEQ ID NO: 18154 - DNA, 23 bp, Artificial Sequence
  X-linked inhibitor of apoptosis (XIAP) siRNA
gtaatattttaaattactatata

SEQ ID NO: 18155 - DNA, 23 bp, Artificial Sequence
  X-linked inhibitor of apoptosis (XIAP) siRNA
taatattttaaattactatatat

SEQ ID NO: 18156 - DNA, 23 bp, Artificial Sequence
  X-linked inhibitor of apoptosis (XIAP) siRNA
aatattttaaattactatatatg

SEQ ID NO: 18157 - DNA, 23 bp, Artificial Sequence
  X-linked inhibitor of apoptosis (XIAP) siRNA
atattttaaattactatatatgt

SEQ ID NO: 18158 - DNA, 23 bp, Artificial Sequence
  X-linked inhibitor of apoptosis (XIAP) siRNA
tattttaaattactatatatgtt

SEQ ID NO: 18159 - DNA, 23 bp, Artificial Sequence
  X-linked inhibitor of apoptosis (XIAP) siRNA
attttaaattactatatatgtta

SEQ ID NO: 18160 - DNA, 23 bp, Artificial Sequence
  X-linked inhibitor of apoptosis (XIAP) siRNA
ttttaaattactatatatgttac

SEQ ID NO: 18161 - DNA, 23 bp, Artificial Sequence
  X-linked inhibitor of apoptosis (XIAP) siRNA
tttaaattactatatatgttacc

SEQ ID NO: 18162 - DNA, 23 bp, Artificial Sequence
  X-linked inhibitor of apoptosis (XIAP) siRNA
ttaaattactatatatgttacca

SEQ ID NO: 18163 - DNA, 23 bp, Artificial Sequence
  X-linked inhibitor of apoptosis (XIAP) siRNA
taaattactatatatgttaccat

SEQ ID NO: 18164 - DNA, 23 bp, Artificial Sequence
  X-linked inhibitor of apoptosis (XIAP) siRNA
aaattactatatatgttaccatt

SEQ ID NO: 18165 - DNA, 23 bp, Artificial Sequence
  X-linked inhibitor of apoptosis (XIAP) siRNA
aattactatatatgttaccattt

SEQ ID NO: 18166 - DNA, 23 bp, Artificial Sequence
  X-linked inhibitor of apoptosis (XIAP) siRNA
attactatatatgttaccatttt

SEQ ID NO: 18167 - DNA, 23 bp, Artificial Sequence
  X-linked inhibitor of apoptosis (XIAP) siRNA
ttactatatatgttaccattttt

SEQ ID NO: 18168 - DNA, 23 bp, Artificial Sequence
  X-linked inhibitor of apoptosis (XIAP) siRNA
tactatatatgttaccatttttc

SEQ ID NO: 18169 - DNA, 23 bp, Artificial Sequence
  X-linked inhibitor of apoptosis (XIAP) siRNA
actatatatgttaccatttttct

SEQ ID NO: 18170 - DNA, 23 bp, Artificial Sequence
  X-linked inhibitor of apoptosis (XIAP) siRNA
ctatatatgttaccatttttctg

SEQ ID NO: 18171 - DNA, 23 bp, Artificial Sequence
  X-linked inhibitor of apoptosis (XIAP) siRNA
tatatatgttaccatttttctgg

SEQ ID NO: 18172 - DNA, 23 bp, Artificial Sequence
  X-linked inhibitor of apoptosis (XIAP) siRNA
atatatgttaccatttttctgga

SEQ ID NO: 18173 - DNA, 23 bp, Artificial Sequence
  X-linked inhibitor of apoptosis (XIAP) siRNA
tatatgttaccatttttctggat

SEQ ID NO: 18174 - DNA, 23 bp, Artificial Sequence
  X-linked inhibitor of apoptosis (XIAP) siRNA
atatgttaccatttttctggatt

SEQ ID NO: 18175 - DNA, 23 bp, Artificial Sequence
  X-linked inhibitor of apoptosis (XIAP) siRNA
tatgttaccatttttctggattt

SEQ ID NO: 18176 - DNA, 23 bp, Artificial Sequence
  X-linked inhibitor of apoptosis (XIAP) siRNA
atgttaccatttttctggattta

SEQ ID NO: 18177 - DNA, 23 bp, Artificial Sequence
  X-linked inhibitor of apoptosis (XIAP) siRNA
tgttaccatttttctggatttag

SEQ ID NO: 18178 - DNA, 23 bp, Artificial Sequence
  X-linked inhibitor of apoptosis (XIAP) siRNA
gttaccatttttctggatttagt

SEQ ID NO: 18179 - DNA, 23 bp, Artificial Sequence
  X-linked inhibitor of apoptosis (XIAP) siRNA
ttaccatttttctggatttagta

SEQ ID NO: 18180 - DNA, 23 bp, Artificial Sequence
  X-linked inhibitor of apoptosis (XIAP) siRNA
taccatttttctggatttagtaa

SEQ ID NO: 18181 - DNA, 23 bp, Artificial Sequence
  X-linked inhibitor of apoptosis (XIAP) siRNA
accatttttctggatttagtaag

SEQ ID NO: 18182 - DNA, 23 bp, Artificial Sequence
  X-linked inhibitor of apoptosis (XIAP) siRNA
ccatttttctggatttagtaaga

SEQ ID NO: 18183 - DNA, 23 bp, Artificial Sequence
  X-linked inhibitor of apoptosis (XIAP) siRNA
catttttctggatttagtaagaa

SEQ ID NO: 18184 - DNA, 23 bp, Artificial Sequence
  X-linked inhibitor of apoptosis (XIAP) siRNA
atttttctggatttagtaagaaa

SEQ ID NO: 18185 - DNA, 23 bp, Artificial Sequence
  X-linked inhibitor of apoptosis (XIAP) siRNA
tttttctggatttagtaagaaat

SEQ ID NO: 18186 - DNA, 23 bp, Artificial Sequence
  X-linked inhibitor of apoptosis (XIAP) siRNA
ttttctggatttagtaagaaatt

SEQ ID NO: 18187 - DNA, 23 bp, Artificial Sequence
  X-linked inhibitor of apoptosis (XIAP) siRNA
tttctggatttagtaagaaattt

SEQ ID NO: 18188 - DNA, 23 bp, Artificial Sequence
  X-linked inhibitor of apoptosis (XIAP) siRNA
ttctggatttagtaagaaatttg

SEQ ID NO: 18189 - DNA, 23 bp, Artificial Sequence
  X-linked inhibitor of apoptosis (XIAP) siRNA
tctggatttagtaagaaatttgc

SEQ ID NO: 18190 - DNA, 23 bp, Artificial Sequence
  X-linked inhibitor of apoptosis (XIAP) siRNA
ctggatttagtaagaaatttgca

SEQ ID NO: 18191 - DNA, 23 bp, Artificial Sequence
  X-linked inhibitor of apoptosis (XIAP) siRNA
tggatttagtaagaaatttgcag

SEQ ID NO: 18192 - DNA, 23 bp, Artificial Sequence
  X-linked inhibitor of apoptosis (XIAP) siRNA
ggatttagtaagaaatttgcagt

SEQ ID NO: 18193 - DNA, 23 bp, Artificial Sequence
  X-linked inhibitor of apoptosis (XIAP) siRNA
gatttagtaagaaatttgcagtt

SEQ ID NO: 18194 - DNA, 23 bp, Artificial Sequence
  X-linked inhibitor of apoptosis (XIAP) siRNA
atttagtaagaaatttgcagttt

SEQ ID NO: 18195 - DNA, 23 bp, Artificial Sequence
  X-linked inhibitor of apoptosis (XIAP) siRNA
tttagtaagaaatttgcagtttt

SEQ ID NO: 18196 - DNA, 23 bp, Artificial Sequence
  X-linked inhibitor of apoptosis (XIAP) siRNA
ttagtaagaaatttgcagttttg

SEQ ID NO: 18197 - DNA, 23 bp, Artificial Sequence
  X-linked inhibitor of apoptosis (XIAP) siRNA
tagtaagaaatttgcagttttgg

SEQ ID NO: 18198 - DNA, 23 bp, Artificial Sequence
  X-linked inhibitor of apoptosis (XIAP) siRNA
agtaagaaatttgcagttttggt

SEQ ID NO: 18199 - DNA, 23 bp, Artificial Sequence
  X-linked inhibitor of apoptosis (XIAP) siRNA
gtaagaaatttgcagttttggtt

SEQ ID NO: 18200 - DNA, 23 bp, Artificial Sequence
  X-linked inhibitor of apoptosis (XIAP) siRNA
taagaaatttgcagttttggttt

SEQ ID NO: 18201 - DNA, 23 bp, Artificial Sequence
  X-linked inhibitor of apoptosis (XIAP) siRNA
aagaaatttgcagttttggtttg

SEQ ID NO: 18202 - DNA, 23 bp, Artificial Sequence
  X-linked inhibitor of apoptosis (XIAP) siRNA
agaaatttgcagttttggtttga

SEQ ID NO: 18203 - DNA, 23 bp, Artificial Sequence
  X-linked inhibitor of apoptosis (XIAP) siRNA
gaaatttgcagttttggtttgat

SEQ ID NO: 18204 - DNA, 23 bp, Artificial Sequence
  X-linked inhibitor of apoptosis (XIAP) siRNA
aaatttgcagttttggtttgatg

SEQ ID NO: 18205 - DNA, 23 bp, Artificial Sequence
  X-linked inhibitor of apoptosis (XIAP) siRNA
aatttgcagttttggtttgatgt

SEQ ID NO: 18206 - DNA, 23 bp, Artificial Sequence
  X-linked inhibitor of apoptosis (XIAP) siRNA
atttgcagttttggtttgatgta

SEQ ID NO: 18207 - DNA, 23 bp, Artificial Sequence
  X-linked inhibitor of apoptosis (XIAP) siRNA
tttgcagttttggtttgatgtaa

SEQ ID NO: 18208 - DNA, 23 bp, Artificial Sequence
  X-linked inhibitor of apoptosis (XIAP) siRNA
ttgcagttttggtttgatgtaac

SEQ ID NO: 18209 - DNA, 23 bp, Artificial Sequence
  X-linked inhibitor of apoptosis (XIAP) siRNA
tgcagttttggtttgatgtaaca

SEQ ID NO: 18210 - DNA, 23 bp, Artificial Sequence
  X-linked inhibitor of apoptosis (XIAP) siRNA
gcagttttggtttgatgtaacaa

SEQ ID NO: 18211 - DNA, 23 bp, Artificial Sequence
  X-linked inhibitor of apoptosis (XIAP) siRNA
cagttttggtttgatgtaacaag

SEQ ID NO: 18212 - DNA, 23 bp, Artificial Sequence
  X-linked inhibitor of apoptosis (XIAP) siRNA
agttttggtttgatgtaacaagg

SEQ ID NO: 18213 - DNA, 23 bp, Artificial Sequence
  X-linked inhibitor of apoptosis (XIAP) siRNA
gttttggtttgatgtaacaaggg

SEQ ID NO: 18214 - DNA, 23 bp, Artificial Sequence
  X-linked inhibitor of apoptosis (XIAP) siRNA
ttttggtttgatgtaacaagggt

SEQ ID NO: 18215 - DNA, 23 bp, Artificial Sequence
  X-linked inhibitor of apoptosis (XIAP) siRNA
tttggtttgatgtaacaagggtt

SEQ ID NO: 18216 - DNA, 23 bp, Artificial Sequence
  X-linked inhibitor of apoptosis (XIAP) siRNA
ttggtttgatgtaacaagggttt

SEQ ID NO: 18217 - DNA, 23 bp, Artificial Sequence
  X-linked inhibitor of apoptosis (XIAP) siRNA
tggtttgatgtaacaagggtttt

SEQ ID NO: 18218 - DNA, 23 bp, Artificial Sequence
  X-linked inhibitor of apoptosis (XIAP) siRNA
ggtttgatgtaacaagggtttta

SEQ ID NO: 18219 - DNA, 23 bp, Artificial Sequence
  X-linked inhibitor of apoptosis (XIAP) siRNA
gtttgatgtaacaagggttttaa

SEQ ID NO: 18220 - DNA, 23 bp, Artificial Sequence
  X-linked inhibitor of apoptosis (XIAP) siRNA
tttgatgtaacaagggttttaat

SEQ ID NO: 18221 - DNA, 23 bp, Artificial Sequence
  X-linked inhibitor of apoptosis (XIAP) siRNA
ttgatgtaacaagggttttaatg

SEQ ID NO: 18222 - DNA, 23 bp, Artificial Sequence
  X-linked inhibitor of apoptosis (XIAP) siRNA
tgatgtaacaagggttttaatgt

SEQ ID NO: 18223 - DNA, 23 bp, Artificial Sequence
  X-linked inhibitor of apoptosis (XIAP) siRNA
gatgtaacaagggttttaatgta

SEQ ID NO: 18224 - DNA, 23 bp, Artificial Sequence
  X-linked inhibitor of apoptosis (XIAP) siRNA
atgtaacaagggttttaatgtaa

SEQ ID NO: 18225 - DNA, 23 bp, Artificial Sequence
  X-linked inhibitor of apoptosis (XIAP) siRNA
tgtaacaagggttttaatgtaat

SEQ ID NO: 18226 - DNA, 23 bp, Artificial Sequence
  X-linked inhibitor of apoptosis (XIAP) siRNA
gtaacaagggttttaatgtaatt

SEQ ID NO: 18227 - DNA, 23 bp, Artificial Sequence
  X-linked inhibitor of apoptosis (XIAP) siRNA
taacaagggttttaatgtaattt

SEQ ID NO: 18228 - DNA, 23 bp, Artificial Sequence
  X-linked inhibitor of apoptosis (XIAP) siRNA
aacaagggttttaatgtaattta

SEQ ID NO: 18229 - DNA, 23 bp, Artificial Sequence
  X-linked inhibitor of apoptosis (XIAP) siRNA
acaagggttttaatgtaatttat

SEQ ID NO: 18230 - DNA, 23 bp, Artificial Sequence
  X-linked inhibitor of apoptosis (XIAP) siRNA
caagggttttaatgtaatttatg

SEQ ID NO: 18231 - DNA, 23 bp, Artificial Sequence
  X-linked inhibitor of apoptosis (XIAP) siRNA
aagggttttaatgtaatttatgt

SEQ ID NO: 18232 - DNA, 23 bp, Artificial Sequence
  X-linked inhibitor of apoptosis (XIAP) siRNA
agggttttaatgtaatttatgtt

SEQ ID NO: 18233 - DNA, 23 bp, Artificial Sequence
  X-linked inhibitor of apoptosis (XIAP) siRNA
gggttttaatgtaatttatgtta

SEQ ID NO: 18234 - DNA, 23 bp, Artificial Sequence
  X-linked inhibitor of apoptosis (XIAP) siRNA
ggttttaatgtaatttatgttag

SEQ ID NO: 18235 - DNA, 23 bp, Artificial Sequence
  X-linked inhibitor of apoptosis (XIAP) siRNA
gttttaatgtaatttatgttaga

SEQ ID NO: 18236 - DNA, 23 bp, Artificial Sequence
  X-linked inhibitor of apoptosis (XIAP) siRNA
ttttaatgtaatttatgttagat

SEQ ID NO: 18237 - DNA, 23 bp, Artificial Sequence
  X-linked inhibitor of apoptosis (XIAP) siRNA
tttaatgtaatttatgttagatt

SEQ ID NO: 18238 - DNA, 23 bp, Artificial Sequence
  X-linked inhibitor of apoptosis (XIAP) siRNA
ttaatgtaatttatgttagattt

SEQ ID NO: 18239 - DNA, 23 bp, Artificial Sequence
  X-linked inhibitor of apoptosis (XIAP) siRNA
taatgtaatttatgttagatttt

SEQ ID NO: 18240 - DNA, 23 bp, Artificial Sequence
  X-linked inhibitor of apoptosis (XIAP) siRNA
aatgtaatttatgttagattttg

SEQ ID NO: 18241 - DNA, 23 bp, Artificial Sequence
  X-linked inhibitor of apoptosis (XIAP) siRNA
atgtaatttatgttagattttgc

SEQ ID NO: 18242 - DNA, 23 bp, Artificial Sequence
  X-linked inhibitor of apoptosis (XIAP) siRNA
tgtaatttatgttagattttgca

SEQ ID NO: 18243 - DNA, 23 bp, Artificial Sequence
  X-linked inhibitor of apoptosis (XIAP) siRNA
gtaatttatgttagattttgcat

SEQ ID NO: 18244 - DNA, 23 bp, Artificial Sequence
  X-linked inhibitor of apoptosis (XIAP) siRNA
taatttatgttagattttgcatt

SEQ ID NO: 18245 - DNA, 23 bp, Artificial Sequence
  X-linked inhibitor of apoptosis (XIAP) siRNA
aatttatgttagattttgcattt

SEQ ID NO: 18246 - DNA, 23 bp, Artificial Sequence
  X-linked inhibitor of apoptosis (XIAP) siRNA
atttatgttagattttgcatttt

SEQ ID NO: 18247 - DNA, 23 bp, Artificial Sequence
  X-linked inhibitor of apoptosis (XIAP) siRNA
tttatgttagattttgcattttt

SEQ ID NO: 18248 - DNA, 23 bp, Artificial Sequence
  X-linked inhibitor of apoptosis (XIAP) siRNA
ttatgttagattttgcatttttt

SEQ ID NO: 18249 - DNA, 23 bp, Artificial Sequence
  X-linked inhibitor of apoptosis (XIAP) siRNA
tatgttagattttgcattttttt

SEQ ID NO: 18250 - DNA, 23 bp, Artificial Sequence
  X-linked inhibitor of apoptosis (XIAP) siRNA
atgttagattttgcatttttttc

SEQ ID NO: 18251 - DNA, 23 bp, Artificial Sequence
  X-linked inhibitor of apoptosis (XIAP) siRNA
tgttagattttgcatttttttca

SEQ ID NO: 18252 - DNA, 23 bp, Artificial Sequence
  X-linked inhibitor of apoptosis (XIAP) siRNA
gttagattttgcatttttttcat

SEQ ID NO: 18253 - DNA, 23 bp, Artificial Sequence
  X-linked inhibitor of apoptosis (XIAP) siRNA
ttagattttgcatttttttcatt

SEQ ID NO: 18254 - DNA, 23 bp, Artificial Sequence
  X-linked inhibitor of apoptosis (XIAP) siRNA
tagattttgcatttttttcatta

SEQ ID NO: 18255 - DNA, 23 bp, Artificial Sequence
  X-linked inhibitor of apoptosis (XIAP) siRNA
agattttgcatttttttcattac

SEQ ID NO: 18256 - DNA, 23 bp, Artificial Sequence
  X-linked inhibitor of apoptosis (XIAP) siRNA
gattttgcatttttttcattact

SEQ ID NO: 18257 - DNA, 23 bp, Artificial Sequence
  X-linked inhibitor of apoptosis (XIAP) siRNA
attttgcatttttttcattactg

SEQ ID NO: 18258 - DNA, 23 bp, Artificial Sequence
  X-linked inhibitor of apoptosis (XIAP) siRNA
ttttgcatttttttcattactgt

SEQ ID NO: 18259 - DNA, 23 bp, Artificial Sequence
  X-linked inhibitor of apoptosis (XIAP) siRNA
tttgcatttttttcattactgtt

SEQ ID NO: 18260 - DNA, 23 bp, Artificial Sequence
  X-linked inhibitor of apoptosis (XIAP) siRNA
ttgcatttttttcattactgtta

SEQ ID NO: 18261 - DNA, 23 bp, Artificial Sequence
  X-linked inhibitor of apoptosis (XIAP) siRNA
tgcatttttttcattactgttat

SEQ ID NO: 18262 - DNA, 23 bp, Artificial Sequence
  X-linked inhibitor of apoptosis (XIAP) siRNA
gcatttttttcattactgttata

SEQ ID NO: 18263 - DNA, 23 bp, Artificial Sequence
  X-linked inhibitor of apoptosis (XIAP) siRNA
catttttttcattactgttatat

SEQ ID NO: 18264 - DNA, 23 bp, Artificial Sequence
  X-linked inhibitor of apoptosis (XIAP) siRNA
atttttttcattactgttatatt

SEQ ID NO: 18265 - DNA, 23 bp, Artificial Sequence
  X-linked inhibitor of apoptosis (XIAP) siRNA
tttttttcattactgttatattt

SEQ ID NO: 18266 - DNA, 23 bp, Artificial Sequence
  X-linked inhibitor of apoptosis (XIAP) siRNA
ttttttcattactgttatatttt

SEQ ID NO: 18267 - DNA, 23 bp, Artificial Sequence
  X-linked inhibitor of apoptosis (XIAP) siRNA
tttttcattactgttatatttta

SEQ ID NO: 18268 - DNA, 23 bp, Artificial Sequence
  X-linked inhibitor of apoptosis (XIAP) siRNA
ttttcattactgttatattttaa

SEQ ID NO: 18269 - DNA, 23 bp, Artificial Sequence
  X-linked inhibitor of apoptosis (XIAP) siRNA
tttcattactgttatattttaac

SEQ ID NO: 18270 - DNA, 23 bp, Artificial Sequence
  X-linked inhibitor of apoptosis (XIAP) siRNA
ttcattactgttatattttaacc

SEQ ID NO: 18271 - DNA, 23 bp, Artificial Sequence
  X-linked inhibitor of apoptosis (XIAP) siRNA
tcattactgttatattttaacct

SEQ ID NO: 18272 - DNA, 23 bp, Artificial Sequence
  X-linked inhibitor of apoptosis (XIAP) siRNA
cattactgttatattttaacctg

SEQ ID NO: 18273 - DNA, 23 bp, Artificial Sequence
  X-linked inhibitor of apoptosis (XIAP) siRNA
attactgttatattttaacctga

SEQ ID NO: 18274 - DNA, 23 bp, Artificial Sequence
  X-linked inhibitor of apoptosis (XIAP) siRNA
ttactgttatattttaacctgac

SEQ ID NO: 18275 - DNA, 23 bp, Artificial Sequence
  X-linked inhibitor of apoptosis (XIAP) siRNA
tactgttatattttaacctgact

SEQ ID NO: 18276 - DNA, 23 bp, Artificial Sequence
  X-linked inhibitor of apoptosis (XIAP) siRNA
actgttatattttaacctgactg

SEQ ID NO: 18277 - DNA, 23 bp, Artificial Sequence
  X-linked inhibitor of apoptosis (XIAP) siRNA
ctgttatattttaacctgactga

SEQ ID NO: 18278 - DNA, 23 bp, Artificial Sequence
  X-linked inhibitor of apoptosis (XIAP) siRNA
tgttatattttaacctgactgac

SEQ ID NO: 18279 - DNA, 23 bp, Artificial Sequence
  X-linked inhibitor of apoptosis (XIAP) siRNA
gttatattttaacctgactgact

SEQ ID NO: 18280 - DNA, 23 bp, Artificial Sequence
  X-linked inhibitor of apoptosis (XIAP) siRNA
ttatattttaacctgactgactg

SEQ ID NO: 18281 - DNA, 23 bp, Artificial Sequence
  X-linked inhibitor of apoptosis (XIAP) siRNA
tatattttaacctgactgactga

SEQ ID NO: 18282 - DNA, 23 bp, Artificial Sequence
  X-linked inhibitor of apoptosis (XIAP) siRNA
atattttaacctgactgactgat

SEQ ID NO: 18283 - DNA, 23 bp, Artificial Sequence
  X-linked inhibitor of apoptosis (XIAP) siRNA
tattttaacctgactgactgatc

SEQ ID NO: 18284 - DNA, 23 bp, Artificial Sequence
  X-linked inhibitor of apoptosis (XIAP) siRNA
attttaacctgactgactgatct

SEQ ID NO: 18285 - DNA, 23 bp, Artificial Sequence
  X-linked inhibitor of apoptosis (XIAP) siRNA
ttttaacctgactgactgatcta

SEQ ID NO: 18286 - DNA, 23 bp, Artificial Sequence
  X-linked inhibitor of apoptosis (XIAP) siRNA
tttaacctgactgactgatctaa

SEQ ID NO: 18287 - DNA, 23 bp, Artificial Sequence
  X-linked inhibitor of apoptosis (XIAP) siRNA
ttaacctgactgactgatctaat

SEQ ID NO: 18288 - DNA, 23 bp, Artificial Sequence
  X-linked inhibitor of apoptosis (XIAP) siRNA
taacctgactgactgatctaatt

SEQ ID NO: 18289 - DNA, 23 bp, Artificial Sequence
  X-linked inhibitor of apoptosis (XIAP) siRNA
aacctgactgactgatctaattg

SEQ ID NO: 18290 - DNA, 23 bp, Artificial Sequence
  X-linked inhibitor of apoptosis (XIAP) siRNA
acctgactgactgatctaattgt

SEQ ID NO: 18291 - DNA, 23 bp, Artificial Sequence
  X-linked inhibitor of apoptosis (XIAP) siRNA
cctgactgactgatctaattgta

SEQ ID NO: 18292 - DNA, 23 bp, Artificial Sequence
  X-linked inhibitor of apoptosis (XIAP) siRNA
ctgactgactgatctaattgtat

SEQ ID NO: 18293 - DNA, 23 bp, Artificial Sequence
  X-linked inhibitor of apoptosis (XIAP) siRNA
tgactgactgatctaattgtatt

SEQ ID NO: 18294 - DNA, 23 bp, Artificial Sequence
  X-linked inhibitor of apoptosis (XIAP) siRNA
gactgactgatctaattgtatta

SEQ ID NO: 18295 - DNA, 23 bp, Artificial Sequence
  X-linked inhibitor of apoptosis (XIAP) siRNA
actgactgatctaattgtattag

SEQ ID NO: 18296 - DNA, 23 bp, Artificial Sequence
  X-linked inhibitor of apoptosis (XIAP) siRNA
ctgactgatctaattgtattagt

SEQ ID NO: 18297 - DNA, 23 bp, Artificial Sequence
  X-linked inhibitor of apoptosis (XIAP) siRNA
tgactgatctaattgtattagta

SEQ ID NO: 18298 - DNA, 23 bp, Artificial Sequence
  X-linked inhibitor of apoptosis (XIAP) siRNA
gactgatctaattgtattagtat

SEQ ID NO: 18299 - DNA, 23 bp, Artificial Sequence
  X-linked inhibitor of apoptosis (XIAP) siRNA
actgatctaattgtattagtatt

SEQ ID NO: 18300 - DNA, 23 bp, Artificial Sequence
  X-linked inhibitor of apoptosis (XIAP) siRNA
ctgatctaattgtattagtattg

SEQ ID NO: 18301 - DNA, 23 bp, Artificial Sequence
  X-linked inhibitor of apoptosis (XIAP) siRNA
tgatctaattgtattagtattgt

SEQ ID NO: 18302 - DNA, 23 bp, Artificial Sequence
  X-linked inhibitor of apoptosis (XIAP) siRNA
gatctaattgtattagtattgtg

SEQ ID NO: 18303 - DNA, 23 bp, Artificial Sequence
  X-linked inhibitor of apoptosis (XIAP) siRNA
atctaattgtattagtattgtga

SEQ ID NO: 18304 - DNA, 23 bp, Artificial Sequence
  X-linked inhibitor of apoptosis (XIAP) siRNA
tctaattgtattagtattgtgaa

SEQ ID NO: 18305 - DNA, 23 bp, Artificial Sequence
  X-linked inhibitor of apoptosis (XIAP) siRNA
ctaattgtattagtattgtgaat

SEQ ID NO: 18306 - DNA, 23 bp, Artificial Sequence
  X-linked inhibitor of apoptosis (XIAP) siRNA
taattgtattagtattgtgaata

SEQ ID NO: 18307 - DNA, 23 bp, Artificial Sequence
  X-linked inhibitor of apoptosis (XIAP) siRNA
aattgtattagtattgtgaataa

SEQ ID NO: 18308 - DNA, 23 bp, Artificial Sequence
  X-linked inhibitor of apoptosis (XIAP) siRNA
attgtattagtattgtgaataat

SEQ ID NO: 18309 - DNA, 23 bp, Artificial Sequence
  X-linked inhibitor of apoptosis (XIAP) siRNA
ttgtattagtattgtgaataatc

SEQ ID NO: 18310 - DNA, 23 bp, Artificial Sequence
  X-linked inhibitor of apoptosis (XIAP) siRNA
tgtattagtattgtgaataatca

SEQ ID NO: 18311 - DNA, 23 bp, Artificial Sequence
  X-linked inhibitor of apoptosis (XIAP) siRNA
gtattagtattgtgaataatcat

SEQ ID NO: 18312 - DNA, 23 bp, Artificial Sequence
  X-linked inhibitor of apoptosis (XIAP) siRNA
tattagtattgtgaataatcatg

SEQ ID NO: 18313 - DNA, 23 bp, Artificial Sequence
  X-linked inhibitor of apoptosis (XIAP) siRNA
attagtattgtgaataatcatgt

SEQ ID NO: 18314 - DNA, 23 bp, Artificial Sequence
  X-linked inhibitor of apoptosis (XIAP) siRNA
ttagtattgtgaataatcatgtg

SEQ ID NO: 18315 - DNA, 23 bp, Artificial Sequence
  X-linked inhibitor of apoptosis (XIAP) siRNA
tagtattgtgaataatcatgtga

SEQ ID NO: 18316 - DNA, 23 bp, Artificial Sequence
  X-linked inhibitor of apoptosis (XIAP) siRNA
agtattgtgaataatcatgtgaa

SEQ ID NO: 18317 - DNA, 23 bp, Artificial Sequence
  X-linked inhibitor of apoptosis (XIAP) siRNA
gtattgtgaataatcatgtgaaa

SEQ ID NO: 18318 - DNA, 23 bp, Artificial Sequence
  X-linked inhibitor of apoptosis (XIAP) siRNA
tattgtgaataatcatgtgaaat

SEQ ID NO: 18319 - DNA, 23 bp, Artificial Sequence
  X-linked inhibitor of apoptosis (XIAP) siRNA
attgtgaataatcatgtgaaatg

SEQ ID NO: 18320 - DNA, 23 bp, Artificial Sequence
  X-linked inhibitor of apoptosis (XIAP) siRNA
ttgtgaataatcatgtgaaatgt

SEQ ID NO: 18321 - DNA, 23 bp, Artificial Sequence
  X-linked inhibitor of apoptosis (XIAP) siRNA
tgtgaataatcatgtgaaatgtt

SEQ ID NO: 18322 - DNA, 23 bp, Artificial Sequence
  X-linked inhibitor of apoptosis (XIAP) siRNA
gtgaataatcatgtgaaatgttt

SEQ ID NO: 18323 - DNA, 23 bp, Artificial Sequence
  X-linked inhibitor of apoptosis (XIAP) siRNA
tgaataatcatgtgaaatgtttt

SEQ ID NO: 18324 - DNA, 23 bp, Artificial Sequence
  X-linked inhibitor of apoptosis (XIAP) siRNA
gaataatcatgtgaaatgttttg

SEQ ID NO: 18325 - DNA, 23 bp, Artificial Sequence
  X-linked inhibitor of apoptosis (XIAP) siRNA
aataatcatgtgaaatgttttga

SEQ ID NO: 18326 - DNA, 23 bp, Artificial Sequence
  X-linked inhibitor of apoptosis (XIAP) siRNA
ataatcatgtgaaatgttttgag

SEQ ID NO: 18327 - DNA, 23 bp, Artificial Sequence
  X-linked inhibitor of apoptosis (XIAP) siRNA
taatcatgtgaaatgttttgaga

SEQ ID NO: 18328 - DNA, 23 bp, Artificial Sequence
  X-linked inhibitor of apoptosis (XIAP) siRNA
aatcatgtgaaatgttttgagac

SEQ ID NO: 18329 - DNA, 23 bp, Artificial Sequence
  X-linked inhibitor of apoptosis (XIAP) siRNA
atcatgtgaaatgttttgagaca

SEQ ID NO: 18330 - DNA, 23 bp, Artificial Sequence
  X-linked inhibitor of apoptosis (XIAP) siRNA
tcatgtgaaatgttttgagacag

SEQ ID NO: 18331 - DNA, 23 bp, Artificial Sequence
  X-linked inhibitor of apoptosis (XIAP) siRNA
catgtgaaatgttttgagacaga

SEQ ID NO: 18332 - DNA, 23 bp, Artificial Sequence
  X-linked inhibitor of apoptosis (XIAP) siRNA
atgtgaaatgttttgagacagag

SEQ ID NO: 18333 - DNA, 23 bp, Artificial Sequence
  X-linked inhibitor of apoptosis (XIAP) siRNA
tgtgaaatgttttgagacagagt

SEQ ID NO: 18334 - DNA, 23 bp, Artificial Sequence
  X-linked inhibitor of apoptosis (XIAP) siRNA
gtgaaatgttttgagacagagta

SEQ ID NO: 18335 - DNA, 23 bp, Artificial Sequence
  X-linked inhibitor of apoptosis (XIAP) siRNA
tgaaatgttttgagacagagtac

SEQ ID NO: 18336 - DNA, 23 bp, Artificial Sequence
  X-linked inhibitor of apoptosis (XIAP) siRNA
gaaatgttttgagacagagtact

SEQ ID NO: 18337 - DNA, 23 bp, Artificial Sequence
  X-linked inhibitor of apoptosis (XIAP) siRNA
aaatgttttgagacagagtacta

SEQ ID NO: 18338 - DNA, 23 bp, Artificial Sequence
  X-linked inhibitor of apoptosis (XIAP) siRNA
aatgttttgagacagagtactat

SEQ ID NO: 18339 - DNA, 23 bp, Artificial Sequence
  X-linked inhibitor of apoptosis (XIAP) siRNA
atgttttgagacagagtactata

SEQ ID NO: 18340 - DNA, 23 bp, Artificial Sequence
  X-linked inhibitor of apoptosis (XIAP) siRNA
tgttttgagacagagtactatat

SEQ ID NO: 18341 - DNA, 23 bp, Artificial Sequence
  X-linked inhibitor of apoptosis (XIAP) siRNA
gttttgagacagagtactatatt

SEQ ID NO: 18342 - DNA, 23 bp, Artificial Sequence
  X-linked inhibitor of apoptosis (XIAP) siRNA
ttttgagacagagtactatattt

SEQ ID NO: 18343 - DNA, 23 bp, Artificial Sequence
  X-linked inhibitor of apoptosis (XIAP) siRNA
tttgagacagagtactatatttg

SEQ ID NO: 18344 - DNA, 23 bp, Artificial Sequence
  X-linked inhibitor of apoptosis (XIAP) siRNA
ttgagacagagtactatatttgt

SEQ ID NO: 18345 - DNA, 23 bp, Artificial Sequence
  X-linked inhibitor of apoptosis (XIAP) siRNA
tgagacagagtactatatttgtg

SEQ ID NO: 18346 - DNA, 23 bp, Artificial Sequence
  X-linked inhibitor of apoptosis (XIAP) siRNA
gagacagagtactatatttgtga

SEQ ID NO: 18347 - DNA, 23 bp, Artificial Sequence
  X-linked inhibitor of apoptosis (XIAP) siRNA
agacagagtactatatttgtgaa

SEQ ID NO: 18348 - DNA, 23 bp, Artificial Sequence
  X-linked inhibitor of apoptosis (XIAP) siRNA
gacagagtactatatttgtgaat

SEQ ID NO: 18349 - DNA, 23 bp, Artificial Sequence
  X-linked inhibitor of apoptosis (XIAP) siRNA
acagagtactatatttgtgaata

SEQ ID NO: 18350 - DNA, 23 bp, Artificial Sequence
  X-linked inhibitor of apoptosis (XIAP) siRNA
cagagtactatatttgtgaatat

SEQ ID NO: 18351 - DNA, 23 bp, Artificial Sequence
  X-linked inhibitor of apoptosis (XIAP) siRNA
agagtactatatttgtgaatata

SEQ ID NO: 18352 - DNA, 23 bp, Artificial Sequence
  X-linked inhibitor of apoptosis (XIAP) siRNA
gagtactatatttgtgaatataa

SEQ ID NO: 18353 - DNA, 23 bp, Artificial Sequence
  X-linked inhibitor of apoptosis (XIAP) siRNA
agtactatatttgtgaatataat

SEQ ID NO: 18354 - DNA, 23 bp, Artificial Sequence
  X-linked inhibitor of apoptosis (XIAP) siRNA
gtactatatttgtgaatataatt

SEQ ID NO: 18355 - DNA, 23 bp, Artificial Sequence
  X-linked inhibitor of apoptosis (XIAP) siRNA
tactatatttgtgaatataattt

SEQ ID NO: 18356 - DNA, 23 bp, Artificial Sequence
  X-linked inhibitor of apoptosis (XIAP) siRNA
actatatttgtgaatataatttt

SEQ ID NO: 18357 - DNA, 23 bp, Artificial Sequence
  X-linked inhibitor of apoptosis (XIAP) siRNA
ctatatttgtgaatataatttta

SEQ ID NO: 18358 - DNA, 23 bp, Artificial Sequence
  X-linked inhibitor of apoptosis (XIAP) siRNA
tatatttgtgaatataattttat

SEQ ID NO: 18359 - DNA, 23 bp, Artificial Sequence
  X-linked inhibitor of apoptosis (XIAP) siRNA
atatttgtgaatataattttatg

SEQ ID NO: 18360 - DNA, 23 bp, Artificial Sequence
  X-linked inhibitor of apoptosis (XIAP) siRNA
tatttgtgaatataattttatgg

SEQ ID NO: 18361 - DNA, 23 bp, Artificial Sequence
  X-linked inhibitor of apoptosis (XIAP) siRNA
atttgtgaatataattttatggt

SEQ ID NO: 18362 - DNA, 23 bp, Artificial Sequence
  X-linked inhibitor of apoptosis (XIAP) siRNA
tttgtgaatataattttatggtt

SEQ ID NO: 18363 - DNA, 23 bp, Artificial Sequence
  X-linked inhibitor of apoptosis (XIAP) siRNA
ttgtgaatataattttatggttt

SEQ ID NO: 18364 - DNA, 23 bp, Artificial Sequence
  X-linked inhibitor of apoptosis (XIAP) siRNA
tgtgaatataattttatggtttt

SEQ ID NO: 18365 - DNA, 23 bp, Artificial Sequence
  X-linked inhibitor of apoptosis (XIAP) siRNA
gtgaatataattttatggttttt

SEQ ID NO: 18366 - DNA, 23 bp, Artificial Sequence
  X-linked inhibitor of apoptosis (XIAP) siRNA
tgaatataattttatggtttttt

SEQ ID NO: 18367 - DNA, 23 bp, Artificial Sequence
  X-linked inhibitor of apoptosis (XIAP) siRNA
gaatataattttatggttttttt

SEQ ID NO: 18368 - DNA, 23 bp, Artificial Sequence
  X-linked inhibitor of apoptosis (XIAP) siRNA
aatataattttatggtttttttc

SEQ ID NO: 18369 - DNA, 23 bp, Artificial Sequence
  X-linked inhibitor of apoptosis (XIAP) siRNA
atataattttatggtttttttca

SEQ ID NO: 18370 - DNA, 23 bp, Artificial Sequence
  X-linked inhibitor of apoptosis (XIAP) siRNA
tataattttatggtttttttcac

SEQ ID NO: 18371 - DNA, 23 bp, Artificial Sequence
  X-linked inhibitor of apoptosis (XIAP) siRNA
ataattttatggtttttttcact

SEQ ID NO: 18372 - DNA, 23 bp, Artificial Sequence
  X-linked inhibitor of apoptosis (XIAP) siRNA
taattttatggtttttttcactt

SEQ ID NO: 18373 - DNA, 23 bp, Artificial Sequence
  X-linked inhibitor of apoptosis (XIAP) siRNA
aattttatggtttttttcactta

SEQ ID NO: 18374 - DNA, 23 bp, Artificial Sequence
  X-linked inhibitor of apoptosis (XIAP) siRNA
attttatggtttttttcacttag

SEQ ID NO: 18375 - DNA, 23 bp, Artificial Sequence
  X-linked inhibitor of apoptosis (XIAP) siRNA
ttttatggtttttttcacttaga

SEQ ID NO: 18376 - DNA, 23 bp, Artificial Sequence
  X-linked inhibitor of apoptosis (XIAP) siRNA
tttatggtttttttcacttagaa

SEQ ID NO: 18377 - DNA, 23 bp, Artificial Sequence
  X-linked inhibitor of apoptosis (XIAP) siRNA
ttatggtttttttcacttagaac

SEQ ID NO: 18378 - DNA, 23 bp, Artificial Sequence
  X-linked inhibitor of apoptosis (XIAP) siRNA
tatggtttttttcacttagaacc

SEQ ID NO: 18379 - DNA, 23 bp, Artificial Sequence
  X-linked inhibitor of apoptosis (XIAP) siRNA
atggtttttttcacttagaacct

SEQ ID NO: 18380 - DNA, 23 bp, Artificial Sequence
  X-linked inhibitor of apoptosis (XIAP) siRNA
tggtttttttcacttagaacctt

SEQ ID NO: 18381 - DNA, 23 bp, Artificial Sequence
  X-linked inhibitor of apoptosis (XIAP) siRNA
ggtttttttcacttagaaccttt

SEQ ID NO: 18382 - DNA, 23 bp, Artificial Sequence
  X-linked inhibitor of apoptosis (XIAP) siRNA
gtttttttcacttagaacctttc

SEQ ID NO: 18383 - DNA, 23 bp, Artificial Sequence
  X-linked inhibitor of apoptosis (XIAP) siRNA
tttttttcacttagaacctttct

SEQ ID NO: 18384 - DNA, 23 bp, Artificial Sequence
  X-linked inhibitor of apoptosis (XIAP) siRNA
ttttttcacttagaacctttctg

SEQ ID NO: 18385 - DNA, 23 bp, Artificial Sequence
  X-linked inhibitor of apoptosis (XIAP) siRNA
tttttcacttagaacctttctgt

SEQ ID NO: 18386 - DNA, 23 bp, Artificial Sequence
  X-linked inhibitor of apoptosis (XIAP) siRNA
ttttcacttagaacctttctgtg

SEQ ID NO: 18387 - DNA, 23 bp, Artificial Sequence
  X-linked inhibitor of apoptosis (XIAP) siRNA
tttcacttagaacctttctgtgt

SEQ ID NO: 18388 - DNA, 23 bp, Artificial Sequence
  X-linked inhibitor of apoptosis (XIAP) siRNA
ttcacttagaacctttctgtgtg

SEQ ID NO: 18389 - DNA, 23 bp, Artificial Sequence
  X-linked inhibitor of apoptosis (XIAP) siRNA
tcacttagaacctttctgtgtgg

SEQ ID NO: 18390 - DNA, 23 bp, Artificial Sequence
  X-linked inhibitor of apoptosis (XIAP) siRNA
cacttagaacctttctgtgtgga

SEQ ID NO: 18391 - DNA, 23 bp, Artificial Sequence
  X-linked inhibitor of apoptosis (XIAP) siRNA
acttagaacctttctgtgtggaa

SEQ ID NO: 18392 - DNA, 23 bp, Artificial Sequence
  X-linked inhibitor of apoptosis (XIAP) siRNA
cttagaacctttctgtgtggaaa

SEQ ID NO: 18393 - DNA, 23 bp, Artificial Sequence
  X-linked inhibitor of apoptosis (XIAP) siRNA
ttagaacctttctgtgtggaaaa

SEQ ID NO: 18394 - DNA, 23 bp, Artificial Sequence
  X-linked inhibitor of apoptosis (XIAP) siRNA
tagaacctttctgtgtggaaaac

SEQ ID NO: 18395 - DNA, 23 bp, Artificial Sequence
  X-linked inhibitor of apoptosis (XIAP) siRNA
agaacctttctgtgtggaaaact

SEQ ID NO: 18396 - DNA, 23 bp, Artificial Sequence
  X-linked inhibitor of apoptosis (XIAP) siRNA
gaacctttctgtgtggaaaacta

SEQ ID NO: 18397 - DNA, 23 bp, Artificial Sequence
  X-linked inhibitor of apoptosis (XIAP) siRNA
aacctttctgtgtggaaaactaa

SEQ ID NO: 18398 - DNA, 23 bp, Artificial Sequence
  X-linked inhibitor of apoptosis (XIAP) siRNA
acctttctgtgtggaaaactaag

SEQ ID NO: 18399 - DNA, 23 bp, Artificial Sequence
  X-linked inhibitor of apoptosis (XIAP) siRNA
cctttctgtgtggaaaactaaga

SEQ ID NO: 18400 - DNA, 23 bp, Artificial Sequence
  X-linked inhibitor of apoptosis (XIAP) siRNA
ctttctgtgtggaaaactaagaa

SEQ ID NO: 18401 - DNA, 23 bp, Artificial Sequence
  X-linked inhibitor of apoptosis (XIAP) siRNA
tttctgtgtggaaaactaagaaa

SEQ ID NO: 18402 - DNA, 23 bp, Artificial Sequence
  X-linked inhibitor of apoptosis (XIAP) siRNA
ttctgtgtggaaaactaagaaaa

SEQ ID NO: 18403 - DNA, 23 bp, Artificial Sequence
  X-linked inhibitor of apoptosis (XIAP) siRNA
tctgtgtggaaaactaagaaaat

SEQ ID NO: 18404 - DNA, 23 bp, Artificial Sequence
  X-linked inhibitor of apoptosis (XIAP) siRNA
ctgtgtggaaaactaagaaaatt

SEQ ID NO: 18405 - DNA, 23 bp, Artificial Sequence
  X-linked inhibitor of apoptosis (XIAP) siRNA
tgtgtggaaaactaagaaaattg

SEQ ID NO: 18406 - DNA, 23 bp, Artificial Sequence
  X-linked inhibitor of apoptosis (XIAP) siRNA
gtgtggaaaactaagaaaattgc

SEQ ID NO: 18407 - DNA, 23 bp, Artificial Sequence
  X-linked inhibitor of apoptosis (XIAP) siRNA
tgtggaaaactaagaaaattgct

SEQ ID NO: 18408 - DNA, 23 bp, Artificial Sequence
  X-linked inhibitor of apoptosis (XIAP) siRNA
gtggaaaactaagaaaattgctt

SEQ ID NO: 18409 - DNA, 23 bp, Artificial Sequence
  X-linked inhibitor of apoptosis (XIAP) siRNA
tggaaaactaagaaaattgcttt

SEQ ID NO: 18410 - DNA, 23 bp, Artificial Sequence
  X-linked inhibitor of apoptosis (XIAP) siRNA
ggaaaactaagaaaattgctttc

SEQ ID NO: 18411 - DNA, 23 bp, Artificial Sequence
  X-linked inhibitor of apoptosis (XIAP) siRNA
gaaaactaagaaaattgctttct

SEQ ID NO: 18412 - DNA, 23 bp, Artificial Sequence
  X-linked inhibitor of apoptosis (XIAP) siRNA
aaaactaagaaaattgctttctg

SEQ ID NO: 18413 - DNA, 23 bp, Artificial Sequence
  X-linked inhibitor of apoptosis (XIAP) siRNA
aaactaagaaaattgctttctgc

SEQ ID NO: 18414 - DNA, 23 bp, Artificial Sequence
  X-linked inhibitor of apoptosis (XIAP) siRNA
aactaagaaaattgctttctgct

SEQ ID NO: 18415 - DNA, 23 bp, Artificial Sequence
  X-linked inhibitor of apoptosis (XIAP) siRNA
actaagaaaattgctttctgctg

SEQ ID NO: 18416 - DNA, 23 bp, Artificial Sequence
  X-linked inhibitor of apoptosis (XIAP) siRNA
ctaagaaaattgctttctgctgt

SEQ ID NO: 18417 - DNA, 23 bp, Artificial Sequence
  X-linked inhibitor of apoptosis (XIAP) siRNA
taagaaaattgctttctgctgta

SEQ ID NO: 18418 - DNA, 23 bp, Artificial Sequence
  X-linked inhibitor of apoptosis (XIAP) siRNA
aagaaaattgctttctgctgtat

SEQ ID NO: 18419 - DNA, 23 bp, Artificial Sequence
  X-linked inhibitor of apoptosis (XIAP) siRNA
agaaaattgctttctgctgtata

SEQ ID NO: 18420 - DNA, 23 bp, Artificial Sequence
  X-linked inhibitor of apoptosis (XIAP) siRNA
gaaaattgctttctgctgtataa

SEQ ID NO: 18421 - DNA, 23 bp, Artificial Sequence
  X-linked inhibitor of apoptosis (XIAP) siRNA
aaaattgctttctgctgtataat

SEQ ID NO: 18422 - DNA, 23 bp, Artificial Sequence
  X-linked inhibitor of apoptosis (XIAP) siRNA
aaattgctttctgctgtataatc

SEQ ID NO: 18423 - DNA, 23 bp, Artificial Sequence
  X-linked inhibitor of apoptosis (XIAP) siRNA
aattgctttctgctgtataatct

SEQ ID NO: 18424 - DNA, 23 bp, Artificial Sequence
  X-linked inhibitor of apoptosis (XIAP) siRNA
attgctttctgctgtataatctg

SEQ ID NO: 18425 - DNA, 23 bp, Artificial Sequence
  X-linked inhibitor of apoptosis (XIAP) siRNA
ttgctttctgctgtataatctgg

SEQ ID NO: 18426 - DNA, 23 bp, Artificial Sequence
  X-linked inhibitor of apoptosis (XIAP) siRNA
tgctttctgctgtataatctggc

SEQ ID NO: 18427 - DNA, 23 bp, Artificial Sequence
  X-linked inhibitor of apoptosis (XIAP) siRNA
gctttctgctgtataatctggca

SEQ ID NO: 18428 - DNA, 23 bp, Artificial Sequence
  X-linked inhibitor of apoptosis (XIAP) siRNA
ctttctgctgtataatctggcat

SEQ ID NO: 18429 - DNA, 23 bp, Artificial Sequence
  X-linked inhibitor of apoptosis (XIAP) siRNA
tttctgctgtataatctggcatt

SEQ ID NO: 18430 - DNA, 23 bp, Artificial Sequence
  X-linked inhibitor of apoptosis (XIAP) siRNA
ttctgctgtataatctggcattc

SEQ ID NO: 18431 - DNA, 23 bp, Artificial Sequence
  X-linked inhibitor of apoptosis (XIAP) siRNA
tctgctgtataatctggcattca

SEQ ID NO: 18432 - DNA, 23 bp, Artificial Sequence
  X-linked inhibitor of apoptosis (XIAP) siRNA
ctgctgtataatctggcattcat

SEQ ID NO: 18433 - DNA, 23 bp, Artificial Sequence
  X-linked inhibitor of apoptosis (XIAP) siRNA
tgctgtataatctggcattcatt

SEQ ID NO: 18434 - DNA, 23 bp, Artificial Sequence
  X-linked inhibitor of apoptosis (XIAP) siRNA
gctgtataatctggcattcattg

SEQ ID NO: 18435 - DNA, 23 bp, Artificial Sequence
  X-linked inhibitor of apoptosis (XIAP) siRNA
ctgtataatctggcattcattgt

SEQ ID NO: 18436 - DNA, 23 bp, Artificial Sequence
  X-linked inhibitor of apoptosis (XIAP) siRNA
tgtataatctggcattcattgta

SEQ ID NO: 18437 - DNA, 23 bp, Artificial Sequence
  X-linked inhibitor of apoptosis (XIAP) siRNA
gtataatctggcattcattgtag

SEQ ID NO: 18438 - DNA, 23 bp, Artificial Sequence
  X-linked inhibitor of apoptosis (XIAP) siRNA
tataatctggcattcattgtaga

SEQ ID NO: 18439 - DNA, 23 bp, Artificial Sequence
  X-linked inhibitor of apoptosis (XIAP) siRNA
ataatctggcattcattgtagat

SEQ ID NO: 18440 - DNA, 23 bp, Artificial Sequence
  X-linked inhibitor of apoptosis (XIAP) siRNA
taatctggcattcattgtagatt

SEQ ID NO: 18441 - DNA, 23 bp, Artificial Sequence
  X-linked inhibitor of apoptosis (XIAP) siRNA
aatctggcattcattgtagatta

SEQ ID NO: 18442 - DNA, 23 bp, Artificial Sequence
  X-linked inhibitor of apoptosis (XIAP) siRNA
atctggcattcattgtagattaa

SEQ ID NO: 18443 - DNA, 23 bp, Artificial Sequence
  X-linked inhibitor of apoptosis (XIAP) siRNA
tctggcattcattgtagattaaa

SEQ ID NO: 18444 - DNA, 23 bp, Artificial Sequence
  X-linked inhibitor of apoptosis (XIAP) siRNA
ctggcattcattgtagattaaag

SEQ ID NO: 18445 - DNA, 23 bp, Artificial Sequence
  X-linked inhibitor of apoptosis (XIAP) siRNA
tggcattcattgtagattaaagc

SEQ ID NO: 18446 - DNA, 23 bp, Artificial Sequence
  X-linked inhibitor of apoptosis (XIAP) siRNA
ggcattcattgtagattaaagct

SEQ ID NO: 18447 - DNA, 23 bp, Artificial Sequence
  X-linked inhibitor of apoptosis (XIAP) siRNA
gcattcattgtagattaaagctt

SEQ ID NO: 18448 - DNA, 23 bp, Artificial Sequence
  X-linked inhibitor of apoptosis (XIAP) siRNA
cattcattgtagattaaagctta

SEQ ID NO: 18449 - DNA, 23 bp, Artificial Sequence
  X-linked inhibitor of apoptosis (XIAP) siRNA
attcattgtagattaaagcttat

SEQ ID NO: 18450 - DNA, 23 bp, Artificial Sequence
  X-linked inhibitor of apoptosis (XIAP) siRNA
ttcattgtagattaaagcttatt

SEQ ID NO: 18451 - DNA, 23 bp, Artificial Sequence
  X-linked inhibitor of apoptosis (XIAP) siRNA
tcattgtagattaaagcttattt

SEQ ID NO: 18452 - DNA, 23 bp, Artificial Sequence
  X-linked inhibitor of apoptosis (XIAP) siRNA
cattgtagattaaagcttatttt

SEQ ID NO: 18453 - DNA, 23 bp, Artificial Sequence
  X-linked inhibitor of apoptosis (XIAP) siRNA
attgtagattaaagcttattttt

SEQ ID NO: 18454 - DNA, 23 bp, Artificial Sequence
  X-linked inhibitor of apoptosis (XIAP) siRNA
ttgtagattaaagcttatttttc

SEQ ID NO: 18455 - DNA, 23 bp, Artificial Sequence
  X-linked inhibitor of apoptosis (XIAP) siRNA
tgtagattaaagcttatttttct

SEQ ID NO: 18456 - DNA, 23 bp, Artificial Sequence
  X-linked inhibitor of apoptosis (XIAP) siRNA
gtagattaaagcttatttttctg

SEQ ID NO: 18457 - DNA, 23 bp, Artificial Sequence
  X-linked inhibitor of apoptosis (XIAP) siRNA
tagattaaagcttatttttctgt

SEQ ID NO: 18458 - DNA, 23 bp, Artificial Sequence
  X-linked inhibitor of apoptosis (XIAP) siRNA
agattaaagcttatttttctgtg

SEQ ID NO: 18459 - DNA, 23 bp, Artificial Sequence
  X-linked inhibitor of apoptosis (XIAP) siRNA
gattaaagcttatttttctgtga

SEQ ID NO: 18460 - DNA, 23 bp, Artificial Sequence
  X-linked inhibitor of apoptosis (XIAP) siRNA
attaaagcttatttttctgtgaa

SEQ ID NO: 18461 - DNA, 23 bp, Artificial Sequence
  X-linked inhibitor of apoptosis (XIAP) siRNA
ttaaagcttatttttctgtgaat

SEQ ID NO: 18462 - DNA, 23 bp, Artificial Sequence
  X-linked inhibitor of apoptosis (XIAP) siRNA
taaagcttatttttctgtgaata

SEQ ID NO: 18463 - DNA, 23 bp, Artificial Sequence
  X-linked inhibitor of apoptosis (XIAP) siRNA
aaagcttatttttctgtgaataa

SEQ ID NO: 18464 - DNA, 23 bp, Artificial Sequence
  X-linked inhibitor of apoptosis (XIAP) siRNA
aagcttatttttctgtgaataaa

SEQ ID NO: 18465 - DNA, 23 bp, Artificial Sequence
  X-linked inhibitor of apoptosis (XIAP) siRNA
agcttatttttctgtgaataaaa

SEQ ID NO: 18466 - DNA, 23 bp, Artificial Sequence
  X-linked inhibitor of apoptosis (XIAP) siRNA
gcttatttttctgtgaataaaac

SEQ ID NO: 18467 - DNA, 23 bp, Artificial Sequence
  X-linked inhibitor of apoptosis (XIAP) siRNA
cttatttttctgtgaataaaacg

SEQ ID NO: 18468 - DNA, 23 bp, Artificial Sequence
  X-linked inhibitor of apoptosis (XIAP) siRNA
ttatttttctgtgaataaaacgt

SEQ ID NO: 18469 - DNA, 23 bp, Artificial Sequence
  X-linked inhibitor of apoptosis (XIAP) siRNA
tatttttctgtgaataaaacgta

SEQ ID NO: 18470 - DNA, 23 bp, Artificial Sequence
  X-linked inhibitor of apoptosis (XIAP) siRNA
atttttctgtgaataaaacgtat

SEQ ID NO: 18471 - DNA, 23 bp, Artificial Sequence
  X-linked inhibitor of apoptosis (XIAP) siRNA
tttttctgtgaataaaacgtatt

SEQ ID NO: 18472 - DNA, 23 bp, Artificial Sequence
  X-linked inhibitor of apoptosis (XIAP) siRNA
ttttctgtgaataaaacgtattc

SEQ ID NO: 18473 - DNA, 23 bp, Artificial Sequence
  X-linked inhibitor of apoptosis (XIAP) siRNA
tttctgtgaataaaacgtattca

SEQ ID NO: 18474 - DNA, 23 bp, Artificial Sequence
  X-linked inhibitor of apoptosis (XIAP) siRNA
ttctgtgaataaaacgtattcaa

SEQ ID NO: 18475 - DNA, 23 bp, Artificial Sequence
  X-linked inhibitor of apoptosis (XIAP) siRNA
tctgtgaataaaacgtattcaat

SEQ ID NO: 18476 - DNA, 23 bp, Artificial Sequence
  X-linked inhibitor of apoptosis (XIAP) siRNA
ctgtgaataaaacgtattcaata

SEQ ID NO: 18477 - DNA, 23 bp, Artificial Sequence
  X-linked inhibitor of apoptosis (XIAP) siRNA
tgtgaataaaacgtattcaataa

SEQ ID NO: 18478 - DNA, 23 bp, Artificial Sequence
  X-linked inhibitor of apoptosis (XIAP) siRNA
gtgaataaaacgtattcaataaa

SEQ ID NO: 18479 - DNA, 23 bp, Artificial Sequence
  X-linked inhibitor of apoptosis (XIAP) siRNA
tgaataaaacgtattcaataaaa

SEQ ID NO: 18480 - DNA, 23 bp, Artificial Sequence
  X-linked inhibitor of apoptosis (XIAP) siRNA
gaataaaacgtattcaataaaat

SEQ ID NO: 18481 - DNA, 23 bp, Artificial Sequence
  X-linked inhibitor of apoptosis (XIAP) siRNA
aataaaacgtattcaataaaata

SEQ ID NO: 18482 - DNA, 23 bp, Artificial Sequence
  X-linked inhibitor of apoptosis (XIAP) siRNA
ataaaacgtattcaataaaatac

SEQ ID NO: 18483 - DNA, 23 bp, Artificial Sequence
  X-linked inhibitor of apoptosis (XIAP) siRNA
taaaacgtattcaataaaatact

SEQ ID NO: 18484 - DNA, 23 bp, Artificial Sequence
  X-linked inhibitor of apoptosis (XIAP) siRNA
aaaacgtattcaataaaatacta

SEQ ID NO: 18485 - DNA, 23 bp, Artificial Sequence
  X-linked inhibitor of apoptosis (XIAP) siRNA
aaacgtattcaataaaatactat

SEQ ID NO: 18486 - DNA, 23 bp, Artificial Sequence
  X-linked inhibitor of apoptosis (XIAP) siRNA
aacgtattcaataaaatactatt

SEQ ID NO: 18487 - DNA, 23 bp, Artificial Sequence
  X-linked inhibitor of apoptosis (XIAP) siRNA
acgtattcaataaaatactattc

SEQ ID NO: 18488 - DNA, 23 bp, Artificial Sequence
  X-linked inhibitor of apoptosis (XIAP) siRNA
cgtattcaataaaatactattct

SEQ ID NO: 18489 - DNA, 23 bp, Artificial Sequence
  X-linked inhibitor of apoptosis (XIAP) siRNA
gtattcaataaaatactattctt

SEQ ID NO: 18490 - DNA, 23 bp, Artificial Sequence
  X-linked inhibitor of apoptosis (XIAP) siRNA
tattcaataaaatactattcttt

SEQ ID NO: 18491 - DNA, 23 bp, Artificial Sequence
  X-linked inhibitor of apoptosis (XIAP) siRNA
attcaataaaatactattcttta

SEQ ID NO: 18492 - DNA, 23 bp, Artificial Sequence
  X-linked inhibitor of apoptosis (XIAP) siRNA
ttcaataaaatactattctttaa

SEQ ID NO: 18493 - DNA, 23 bp, Artificial Sequence
  X-linked inhibitor of apoptosis (XIAP) siRNA
tcaataaaatactattctttaaa

SEQ ID NO: 18494 - DNA, 23 bp, Artificial Sequence
  X-linked inhibitor of apoptosis (XIAP) siRNA
caataaaatactattctttaaaa

SEQ ID NO: 18495 - DNA, 23 bp, Artificial Sequence
  X-linked inhibitor of apoptosis (XIAP) siRNA
aataaaatactattctttaaaat

SEQ ID NO: 18496 - DNA, 23 bp, Artificial Sequence
  X-linked inhibitor of apoptosis (XIAP) siRNA
ataaaatactattctttaaaatt

SEQ ID NO: 18497 - DNA, 23 bp, Artificial Sequence
  X-linked inhibitor of apoptosis (XIAP) siRNA
taaaatactattctttaaaatta
